United States Patent 12,569,549 (FLAVIVIRUS VACCINE) - sequence listing, part 48

SEQ ID NO: 17445 - RNA, 9876 nt, synthetic construct
  misc_feature 1..9876: note = derived and/or modified CDS sequence (opt4) from DENV-2__FJ410223__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggagaacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctggccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcggcaacctgaagaacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggtggccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17446 - RNA, 9876 nt, synthetic construct
  misc_feature 1..9876: note = derived and/or modified CDS sequence (opt4) from DENV-2__FJ410224__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccgtgacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcaccgtgaccctgtacctgggcgtgatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagacctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17447 - RNA, 9876 nt, synthetic construct
  misc_feature 1..9876: note = derived and/or modified CDS sequence (opt4) from DENV-2__FJ461321__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacagcgtgggcaacgacaccggcaagcacggcatggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccaacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagagcgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcacaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagaatcctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17448 - RNA, 9876 nt, synthetic construct
  misc_feature 1..9876: note = derived and/or modified CDS sequence (opt4) from DENV-2__FJ410228__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcatggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaacggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcacaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagaatcctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17449 - RNA, 9876 nt, synthetic construct
  misc_feature 1..9876: note = derived and/or modified CDS sequence (opt4) from DENV-2__FJ410233__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcaacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccaccagacagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgaagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17450 - RNA, 9876 nt, synthetic construct
  misc_feature 1..9876: note = derived and/or modified CDS sequence (opt4) from DENV-2__FJ410237__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgaagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggatcgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacgccgactacatgcccagcatgaagagattcagaagagaggaggaggaggccggcgtgctgtggtga

SEQ ID NO: 17451 - RNA, 9876 nt, synthetic construct
  misc_feature 1..9876: note = derived and/or modified CDS sequence (opt4) from DENV-2__FJ410241__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgaagaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgagaatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagctggagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17452 - RNA, 9876 nt, synthetic construct
  misc_feature 1..9876: note = derived and/or modified CDS sequence (opt4) from DENV-2__FJ410259__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcatggagatcaaggtgaccccccagagcagcaccaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggccgccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcacaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagaatcctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17453 - RNA, 9876 nt, synthetic construct
  misc_feature 1..9876: note = derived and/or modified CDS sequence (opt4) from DENV-2__FJ547067__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccatcagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgccgtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccaggtgtacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcagaaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17454 - RNA, 9876 nt, synthetic construct
  misc_feature 1..9876: note = derived and/or modified CDS sequence (opt4) from DENV-2__JN819418__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcatgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17455 - RNA, 9876 nt, synthetic construct
  misc_feature 1..9876: note = derived and/or modified CDS sequence (opt4) from DENV-2__EU482640__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccaccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggagacagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacagcagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccgtgcccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagcagacagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcatgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17456 - RNA, 9876 nt, synthetic construct
  misc_feature 1..9876: note = derived and/or modified CDS sequence (opt4) from DENV-2__EU482641__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccatcaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcatggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcacaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagaatcctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17457 - RNA, 9876 nt, synthetic construct
  misc_feature 1..9876: note = derived and/or modified CDS sequence (opt4) from DENV-2__EU482642__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgttcgagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatctgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17458 - RNA, 9876 nt, synthetic construct
  misc_feature 1..9876: note = derived and/or modified CDS sequence (opt4) from DENV-2__EU482643__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatgaagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccaccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtgaccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagacaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatgggcaacgaggagtacaccgactacatgcccagcatgaagagattcagaagagaggaggaggaggccggcgtgctgtggtga

SEQ ID NO: 17459 - RNA, 9876 nt, synthetic construct
  misc_feature 1..9876: note = derived and/or modified CDS sequence (opt4) from DENV-2__EU482644__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcaccggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatgaccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17460 - RNA, 9876 nt, synthetic construct
  misc_feature 1..9876: note = derived and/or modified CDS sequence (opt4) from DENV-2__EU482645__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagaaggtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcaccggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatgaccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17461 - RNA, 9876 nt, synthetic construct
  misc_feature 1..9876: note = derived and/or modified CDS sequence (opt4) from DENV-2__EU482646__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcaccaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17462 - RNA, 9876 nt, synthetic construct
  misc_feature 1..9876: note = derived and/or modified CDS sequence (opt4) from DENV-2__EU482647__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatgaagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagacctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17463 - RNA, 9876 nt, synthetic construct
  misc_feature 1..9876: note = derived and/or modified CDS sequence (opt4) from DENV-2__EU482648__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgccatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcatgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctgatcgcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagagactggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17464 - RNA, 9876 nt, synthetic construct
  misc_feature 1..9876: note = derived and/or modified CDS sequence (opt4) from DENV-2__EU482649__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccatcgcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgagctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtggtgctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagaacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17465 - RNA, 9876 nt, synthetic construct
  misc_feature 1..9876: note = derived and/or modified CDS sequence (opt4) from DENV-2__EU482650__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcaagttctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacaccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17466 - RNA, 9876 nt, synthetic construct
  misc_feature 1..9876: note = derived and/or modified CDS sequence (opt4) from DENV-2__EU482651__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgagactgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcaccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtgaccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtggtgctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17467 - RNA, 9876 nt, synthetic construct
  misc_feature 1..9876: note = derived and/or modified CDS sequence (opt4) from DENV-2__EU482652__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcctgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcgccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcaccctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgaagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacgccgactacatgcccagcatgaagagattcagaagagaggaggaggaggccggcgtgctgtggtga

SEQ ID NO: 17468 - RNA, 9876 nt, synthetic construct
  misc_feature 1..9876: note = derived and/or modified CDS sequence (opt4) from DENV-2__EU482653__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcgtgaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgagactgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcttcggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacgccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17469 - RNA, 9876 nt, synthetic construct
  misc_feature 1..9876: note = derived and/or modified CDS sequence (opt4) from DENV-2__EU482654__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagatgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacaccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17470 - RNA, 9876 nt, synthetic construct
  misc_feature 1..9876: note = derived and/or modified CDS sequence (opt4) from DENV-2__EU482656__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcgtgaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcctggacgaggagagagagatccccgagagaagctggaacagcggccacgagtgggtgaccgacttcgagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcgtggccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17471 - RNA, 9876 nt, synthetic construct
  misc_feature 1..9876: note = derived and/or modified CDS sequence (opt4) from DENV-2__EU482657__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcatgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatggagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcaccctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgaggccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcacaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17472 - RNA, 9876 nt, synthetic construct
  misc_feature 1..9876: note = derived and/or modified CDS sequence (opt4) from DENV-2__EU482658__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtgatcgtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccaccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtgaccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagacaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17473 - RNA, 9876 nt, synthetic construct
  misc_feature 1..9876: note = derived and/or modified CDS sequence (opt4) from DENV-2__EU482659__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccaccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacaccggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagcacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcgacgaggagtacaccgactacatgcccagcatgaagagattcagaagagaggaggaggaggccggcgtgctgtggtga

SEQ ID NO: 17474 - RNA, 9876 nt, synthetic construct
  misc_feature 1..9876: note = derived and/or modified CDS sequence (opt4) from DENV-2__EU482661__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgagggcgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17475 - RNA, 9876 nt, synthetic construct
  misc_feature 1..9876: note = derived and/or modified CDS sequence (opt4) from DENV-2__EU482662__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagaaggccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgccatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcatgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctgatcgcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagagactggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17476 - RNA, 9876 nt, synthetic construct
  misc_feature 1..9876: note = derived and/or modified CDS sequence (opt4) from DENV-2__EU482663__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgagaaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacatcgactacatgcccagcatgaagagattcagaagagaggaggaggaggccggcgtgctgtggtga

SEQ ID NO: 17477 - RNA, 9876 nt, synthetic construct
  misc_feature 1..9876: note = derived and/or modified CDS sequence (opt4) from DENV-2__EU482664__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgccatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcgtggccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctgatcgcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagagactggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17478 - RNA, 9876 nt, synthetic construct
  misc_feature 1..9876: note = derived and/or modified CDS sequence (opt4) from DENV-2__EU482665__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17479 - RNA, 9876 nt, synthetic construct
  misc_feature 1..9876: note = derived and/or modified CDS sequence (opt4) from DENV-2__EU482666__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgccatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcatgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcatgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctgatcgcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagagactggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17480 - RNA, 9876 nt, synthetic construct
  misc_feature 1..9876: note = derived and/or modified CDS sequence (opt4) from DENV-2__EU482667__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggaggccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcaaggtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17481 - RNA, 9876 nt, synthetic construct
  misc_feature 1..9876: note = derived and/or modified CDS sequence (opt4) from DENV-2__EU482668__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcatggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcacaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagaatcctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17482 - RNA, 9876 nt, synthetic construct
  misc_feature 1..9876: note = derived and/or modified CDS sequence (opt4) from DENV-2__EU482669__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcgcctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggtggagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgactacaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaccatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17483 - RNA, 9876 nt, synthetic construct
  misc_feature 1..9876: note = derived and/or modified CDS sequence (opt4) from DENV-2__EU482670__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtgatgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccaggtggccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagaatcctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17484 - RNA, 9876 nt, synthetic construct
  misc_feature 1..9876: note = derived and/or modified CDS sequence (opt4) from DENV-2__EU482671__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgagagagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17485 - RNA, 9876 nt, synthetic construct
  misc_feature 1..9876: note = derived and/or modified CDS sequence (opt4) from DENV-2__EU482674__SS-prME
  source 1..9876: mol_type = other RNA
agcgccggcatgatcatcatgctgatccccaccgtgatggccttccacctgaccaccagaaacggcgagccccacatgatcgtgagcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggccacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagaacatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagaagcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcacaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17486 - RNA, 9876 nt, synthetic construct
  misc_feature 1..9876: note = derived and/or modified CDS sequence (opt4) from DENV-2__EU482676__SS-prME
  source 1..9876: mol_type = other RNA
agcgccagcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcaaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcagaatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgtgttctgcgacagcaagctgatgagcgccgccatcaaggacaacagagccgtgcacgccgacatgggctactggatcgagagcgccctgaacgacacctggaagatcgagagagccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgagaaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17487 - RNA, 9876 nt, synthetic construct
  misc_feature 1..9876: note = derived and/or modified CDS sequence (opt4) from DENV-2__EU482677__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcgtgaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccagcaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccaagaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagacctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcaacgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggtggccatcaaccaggtgagaagcctgatcggcaacgaggagtacaccgactacatgcccagcatgaagagattcagaagagaggaggaggaggccggcgtgctgtggtga

SEQ ID NO: 17488 - RNA, 9876 nt, synthetic construct
  misc_feature 1..9876: note = derived and/or modified CDS sequence (opt4) from DENV-2__EU482678__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacgagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccaccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctggccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacaccggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17489 - RNA, 9876 nt, synthetic construct
  misc_feature 1..9876: note = derived and/or modified CDS sequence (opt4) from DENV-2__EU482679__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgggcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17490 - RNA, 9876 nt, synthetic construct
  misc_feature 1..9876: note = derived and/or modified CDS sequence (opt4) from DENV-2__EU482774__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcttcatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtggtgctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccaagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17491 - RNA, 9876 nt, synthetic construct
  misc_feature 1..9876: note = derived and/or modified CDS sequence (opt4) from DENV-2__EU482775__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgagaaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcacaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17492 - RNA, 9876 nt, synthetic construct
  misc_feature 1..9876: note = derived and/or modified CDS sequence (opt4) from DENV-2__EU482776__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgcctacaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggccagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagaatcctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgaggccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcacaactggctggccagagtgggctgcgagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcctggagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17493 - RNA, 9876 nt, synthetic construct
  misc_feature 1..9876: note = derived and/or modified CDS sequence (opt4) from DENV-2__EU482777__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17494 - RNA, 9876 nt, synthetic construct
  misc_feature 1..9876: note = derived and/or modified CDS sequence (opt4) from DENV-2__EU482778__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccgtgggcaccacccacttccagagagccctgatcttcatcctgctggccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagccccatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagaactgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccgccatgaccgacgacatcggcatcggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccaccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcgccgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggcacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccgtgcccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17495 - RNA, 9876 nt, synthetic construct
  misc_feature 1..9876: note = derived and/or modified CDS sequence (opt4) from DENV-2__EU482779__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccgtgggcaccacccacttccagagagccctgatcttcatcctgctggccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagccccatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtgaccgtgagcttcgtgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcgccgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcgtgaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaaggacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17496 - RNA, 9876 nt, synthetic construct
  misc_feature 1..9876: note = derived and/or modified CDS sequence (opt4) from DENV-2__EU482780__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccgtgggcaccacccacttccagagagccctgatcttcatcctgctggccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagccccatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtgaccgtgagcttcgtgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcgccgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcgtgaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaaggacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagaatgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17497 - RNA, 9876 nt, synthetic construct
  misc_feature 1..9876: note = derived and/or modified CDS sequence (opt4) from DENV-2__EU482781__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccgtgggcaccacccacttccagagagccctgatcttcatcctgctggccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagccccatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcagcccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtgaccgtgagcttcgtgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcgccgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcgtgaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaaggacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctggaagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17498 - RNA, 9876 nt, synthetic construct
  misc_feature 1..9876: note = derived and/or modified CDS sequence (opt4) from DENV-2__EU482782__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgtggccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcacaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17499 - RNA, 9876 nt, synthetic construct
  misc_feature 1..9876: note = derived and/or modified CDS sequence (opt4) from DENV-2__EU482783__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccgtgggcaccacccacttccagagagccctgatcttcatcctgctggccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagccccatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcggcatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtgaccgtgagcttcgtgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcgccgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaaggacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17500 - RNA, 9876 nt, synthetic construct
  misc_feature 1..9876: note = derived and/or modified CDS sequence (opt4) from DENV-2__EU482784__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgtgttctgcgacagcaagctgatgagcgccgccatcaaggacagcagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcacaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17501 - RNA, 9876 nt, synthetic construct
  misc_feature 1..9876: note = derived and/or modified CDS sequence (opt4) from DENV-2__EU482785__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccgtgggcaccacccacttccagagagccctgatcttcatcctgctggccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagccccatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtgaccgtgagcttcgtgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcgccgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcgtgaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaaggacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17502 - RNA, 9876 nt, synthetic construct
  misc_feature 1..9876: note = derived and/or modified CDS sequence (opt4) from DENV-2__EU482786__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccggcaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtggtgctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacggcgactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccaagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17503 - RNA, 9876 nt, synthetic construct
  misc_feature 1..9876: note = derived and/or modified CDS sequence (opt4) from DENV-2__EU482787__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccgtgggcaccacccacttccagagagccctgatcttcatcctgctggccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagccccatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtgaccgtgagcttcgtgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcgccgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccagcaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcgtgaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaaggacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17504 - RNA, 9876 nt, synthetic construct
  misc_feature 1..9876: note = derived and/or modified CDS sequence (opt4) from DENV-2__EU482788__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccgtgggcaccacccacttccagagagccctgatcttcatcctgctggccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagccccatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtgaccgtgagcttcgtgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcgccgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaaggacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17505 - RNA, 9876 nt, synthetic construct
  misc_feature 1..9876: note = derived and/or modified CDS sequence (opt4) from DENV-2__EU482697__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacagagagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcaccgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacttccacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgaagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17506 - RNA, 9876 nt, synthetic construct
  misc_feature 1..9876: note = derived and/or modified CDS sequence (opt4) from DENV-2__EU482699__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgagactgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcatcctgggcatggccctgttcctggaggagatgctgagaaccagagtgggcaccaagcacgccatcctgctggccgccgtgagcttcgtgaccctgatcaccggcaacatgagcttcaaggacctgggcagagtgatggtgatggtgggcgccaccatggccgacgacatcggcatgggcgtgacctacctggccctgctggccgccttcaaggtgagacccaccttcgccgccggcctgctgctgagaagactgaccagcaaggagctgatgatgaccaccatcggcatcgtgctgctgagccagagcaccatccccgagaccgtgctggagctgaccgacgccctggccctgggcatgatggtgctgaagatcgtgagaaagatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaagggcggcgagaagaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17507 - RNA, 9876 nt, synthetic construct
  misc_feature 1..9876: note = derived and/or modified CDS sequence (opt4) from DENV-2__EU482701__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgaagcagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacgccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgagactgaaggagaagcaggacgccttctgcgacagcaagctgatgagcgccgccgtgaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatggtgatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcatcctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcgtggtgctgctgagccagagcaccatccccgacaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17508 - RNA, 9876 nt, synthetic construct
  misc_feature 1..9876: note = derived and/or modified CDS sequence (opt4) from DENV-2__EU482703__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgggctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17509 - RNA, 9876 nt, synthetic construct
  misc_feature 1..9876: note = derived and/or modified CDS sequence (opt4) from DENV-2__EU482705__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccaccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacaacatcggcatgggcgtgacctacctggccctgctggccgccttcaaggtgagacccaccttcgccgccggcctgctgctgagaagactgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagagactggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17510 - RNA, 9876 nt, synthetic construct
  misc_feature 1..9876: note = derived and/or modified CDS sequence (opt4) from DENV-2__EU482463__SS-prME
  source 1..9876: mol_type = other RNA
agcgccggcatgatcatcatgctgatccccaccgtgatggccttccacctgaccaccagaaacggcgagccccacatgatcgtgagcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagaagcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcacaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17511 - RNA, 9876 nt, synthetic construct
  misc_feature 1..9876: note = derived and/or modified CDS sequence (opt4) from DENV-2__EU482464__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccaccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcaccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctggccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17512 - RNA, 9876 nt, synthetic construct
  misc_feature 1..9876: note = derived and/or modified CDS sequence (opt4) from DENV-2__EU482465__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcaccgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcaccaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17513 - RNA, 9876 nt, synthetic construct
  misc_feature 1..9876: note = derived and/or modified CDS sequence (opt4) from DENV-2__EU482466__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccctgcccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17514 - RNA, 9876 nt, synthetic construct
  misc_feature 1..9876: note = derived and/or modified CDS sequence (opt4) from DENV-2__EU482467__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacagaaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccaccacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17515 - RNA, 9876 nt, synthetic construct
  misc_feature 1..9876: note = derived and/or modified CDS sequence (opt4) from DENV-2__EU482468__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcatgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatggagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcaccctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcacaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17516 - RNA, 9876 nt, synthetic construct
  misc_feature 1..9876: note = derived and/or modified CDS sequence (opt4) from DENV-2__EU482469__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcccacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcatggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagaacatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacaccggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcacaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagaatcctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17517 - RNA, 9876 nt, synthetic construct
  misc_feature 1..9876: note = derived and/or modified CDS sequence (opt4) from DENV-2__EU482470__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatgaccatcctgtgcgtgcccaacgccgtgatcctgcagaacgcctggaaggtgagctgcaccatcctggccgtggtgagcgtgagccccctgctgctgaccagcagcagacagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17518 - RNA, 9876 nt, synthetic construct
  misc_feature 1..9876: note = derived and/or modified CDS sequence (opt4) from DENV-2__EU482471__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacagcgtgggcaacgacaccggcaagcacggcatggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccaacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcacaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagaatcctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17519 - RNA, 9876 nt, synthetic construct
  misc_feature 1..9876: note = derived and/or modified CDS sequence (opt4) from DENV-2__EU482472__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatggagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcatcatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcacaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17520 - RNA, 9876 nt, synthetic construct
  misc_feature 1..9876: note = derived and/or modified CDS sequence (opt4) from DENV-2__EU482473__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggtggccatcaaccaggtgagaagcctgatcggcaacgaggagtacaccgactacatgcccagcatgaagagattcagaagagaggaggaggaggccggcgtgctgtggtga

SEQ ID NO: 17521 - RNA, 9876 nt, synthetic construct
  misc_feature 1..9876: note = derived and/or modified CDS sequence (opt4) from DENV-2__EU482474__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccatcaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgagactgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccgtggacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcgtgaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17522 - RNA, 9876 nt, synthetic construct
  misc_feature 1..9876: note = derived and/or modified CDS sequence (opt4) from DENV-2__EU482475__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgtggacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17523 - RNA, 9876 nt, synthetic construct
  misc_feature 1..9876: note = derived and/or modified CDS sequence (opt4) from DENV-2__EU482541__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcatggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcagaggcatcatgcaggccggcaagagaagcctgagaccccagcccgccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagagactgaccgtgaccgaggaggtggccgtgcacaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagaatcctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17524 - RNA, 9876 nt, synthetic construct
  misc_feature 1..9876: note = derived and/or modified CDS sequence (opt4) from DENV-2__EU482542__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaaggtgcccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcacctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgaagaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagaatcctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17525 - RNA, 9876 nt, synthetic construct
  misc_feature 1..9876: note = derived and/or modified CDS sequence (opt4) from DENV-2__JX966380__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccaaggacggcaccaacatgtgcaccctgatggccatggacctgggcgagctgtgcgaggacaccatcacctacaagtgccccttcctgaagcagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccatcgcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgacagcagatgccccacccagggcgagcccaccctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccgtggtgatcaccccccacagcggcgaggagcacgccgtgggcaacgacaccggcaagcacggcaaggaggtgaagatcaccccccagagcagcatcaccgaggccgagctgaccggctacggcaccgtgaccatggagtgcagccccagaaccggcctggacttcaacgagatggtgctgctgcagatgaaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctggactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcgtgaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcaccagcgagctgaaccacatcctgagcgagaacgaggtgaagctgaccatcatgaccggcgacatcaagggcatcatgcaggtgggcaagagaagcctgagaccccagcccaccgagctgagatacagctggaagacctggggcaaggccaagaccctgagcaccgagctgcacaaccagaccttcctgatcgacggccccgagaccgccgagtgccccaacaccaacagagcctggaacagcctggaggtggaggactacggcttcggcgtgttcaccaccaacatctggctgagactgagagagaagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatggtgatccccaagaacttcgccggccccgtgagccagcacaacaacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgagcagcctggtgaccgccggccacggccagatcgacaacttcagcctgggcatcctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcaccgccggcctgctgctgagaaagctgaccagcaaggagctgatgatgaccaccatcggcatcgtgctgctgagccagagcagcatccccgagaccatcctggagctgaccgacgccctggccctgggcatgatggtgctgaagatggtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggacgaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcagaaccaacaccggcaccatcggcgccgtgagcctggacttcagccccggcaccagcggcagccccatcgtggacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaagaccggcaacgacatcgccgcctgcctgagaaagaacggcaagagagtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccagaaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcaccagaaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcaaggcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtgatcatcgccatcctgaccgtggtggccgccaccatggccaacgagatgggcttcctggagaagaccaagaaggacctgggcctgggcaacatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccgtgagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcgtgccccccgagaagtgcgacaccctgctgtgcgacatcggcgagagcagccccaaccccaccgtggaggccggcagaaccctgagagtgctgaacctggtggagaactggctgaacaacaacacccagttctgcgtgaaggtgctgaacccctacatgcccagcgtgatcgagagaatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccatcgaggacctgaagaacgaggagatgatcaccaaccacatggccggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagaacatccagcacctgaccgccagcgaggagatcgccgtgcaggactggctggtgagagtgggcagagagagactgagcagaatggccatcagcggcgacgactgcgtggtgaagcccctggacgacagattcgccagagccctgaccgccctgaacgacatgggcaaggtgagaaaggacatccagcagtgggagcccagcagaggctggaacgactggacccaggtgcccttctgcagccaccacttccacgagctgatcatgaaggacggcagaaccctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagccacgagtggatgaccaccgaggacatgctgaccgtgtggaacaaggtgtggatcctggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17526 - RNA, 9876 nt, synthetic construct
  misc_feature 1..9876: note = derived and/or modified CDS sequence (opt4) from DENV-2__JX966379__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccaaggacggcaccaacatgtgcaccctgatggccatggacctgggcgagctgtgcgaggacaccatcacctacaagtgccccttcctgaagcagaacgagcccgaggacatcgactgctggtgcaacagcaccagcacctgggtgacctacggcacctgcaccaccaccggcgagcacagaagaggcaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccatcgcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccagcctgagaaagtactgcatcgaggccaagctgaccaacaccaccaccgacagcagatgccccacccagggcgagcccaccctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccgtggtgatcaccccccacagcggcgaggagcacgccgtgggcaacgacaccggcaagcacggcaaggaggtgaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctggactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcgtgaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggtgggcaagagaagcctgagaccccagcccaccgagctgagatacagctggaagacctggggcaaggccaagatgctgagcaccgagctgcacaaccagaccttcctgatcgacggccccgagaccgccgagtgccccaacaccaacagagcctggaacagcctggaggtggaggactacggcttcggcgtgttcaccaccaacatctggctgagactgagagagaagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatggtgatccccaagaactacgccggccccgtgagccagcacaacaacagacccggctaccacacccagaccgccggcccctggcacctgggcaagctggagatggacttcgacttctgcgagggcaccaccgtggtggtgaccgaggagtgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgagcagcctggtgaccgccggccacggccagatcgacaacttcagcctgggcatcctgggcatggccctgttcctggaggagatgctgagaagcagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgcctacaaggtgagacccaccttcgccgccggcctgctgctgagaaagctgaccagcaaggagctgatgatgaccaccatcggcatcgtgctgctgagccagagcagcatccccgagaccatcctggagctgaccgacgccctggccctgggcatgatggtgctgaagatggtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggacgaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcacccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcagaaccaacaccggcaccatcggcgccgtgagcctggacttcagccccggcaccagcggcagccccatcgtggacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccacctgcctgagaaagaacggcaagagagtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccagaaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccagcgagggcatcaactacgccgacagaagatggtgcttcgacggcaccagaaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcaaggcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtgatcatcgccatcctgaccgtggtggccgccaccatggccaacgagatgggcttcctggagaagaccaagaaggacctgggcctgggccacatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccgtgagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcgtgccccccgagaagtgcgacaccctgctgtgcgacatcggcgagagcagccccaaccccaccgtggaggccggcagaaccctgagagtgctgaacctggtggagaactggctgaacgacaacacccagttctgcgtgaaggtgctgaacccctacatgcccagcgtgatcgagagaatggagaccctgcagagaaagtacggcggcgccctggtgagaaaccccctgagcagaaacagcacccacgagatgtactgggtgagcaacgccagcggcaacgtggtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgaggccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacaacagattctgggagctggtggacaaggagagaaacctgcacctggagggcaagtgcgagacctgcgtgtacaacatgatgggcaagagagagaagaagctgggcgagttcggcaaggccagaggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccatcgaggacctgaagaacgaggagatgatcaccaaccacatggccggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcatcttcaagagcatccagcacctgaccgccagcgaggagatcgccgtgcaggactggctggccagagtgggcagagagagactgagcagaatggccatcagcggcgacgactgcgtggtgaagcccctggacgacagattcgccagagccctgaccgccctgaacgacatgggcaaggtgagaaaggacatccagcagtgggagcccagcagaggctggaacgactggacccaggtgcccttctgcagccaccacttccacgagctgatcatgaaggacggcagaaccctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagccacgagtggatgaccaccgaggacatgctgaccgtgtggaacagagtgtggatcctggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17527 - RNA, 9876 nt, synthetic construct
  misc_feature 1..9876: note = derived and/or modified CDS sequence (opt4) from DENV-2__KP012546__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatgcccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcagcacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcaccaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggaacctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17528 - RNA, 9876 nt, synthetic construct
  misc_feature 1..9876: note = derived and/or modified CDS sequence (opt4) from DENV-2__KP723478__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccatgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatgcccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcacccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcagcacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcaccaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggaacctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17529 - RNA, 9876 nt, synthetic construct
  misc_feature 1..9876: note = derived and/or modified CDS sequence (opt4) from DENV-2__KP723479__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagatgaaggagagacaggacgtgttctgcgacagcaagctgatgagcgccgccatcaaggacagcagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccaggccaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtggtgagcggcctgttccccgtgagcacccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagaacaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17530 - RNA, 9876 nt, synthetic construct
  misc_feature 1..9876: note = derived and/or modified CDS sequence (opt4) from DENV-2__KT187554__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatgcccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgttcctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcagcacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcaccaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagagagagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggaacctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17531 - RNA, 9876 nt, synthetic construct
  misc_feature 1..9876: note = derived and/or modified CDS sequence (opt4) from DENV-2__KT187557__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccatgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatgcccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcagcacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcaccaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggaacctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17532 - RNA, 9876 nt, synthetic construct
  misc_feature 1..9876: note = derived and/or modified CDS sequence (opt4) from DENV-2__JQ045670__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccgccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagacctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaacgacctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17533 - RNA, 9876 nt, synthetic construct
  misc_feature 1..9876: note = derived and/or modified CDS sequence (opt4) from DENV-2__JQ045686__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgtgatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggccaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatcaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcaacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgtgggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagagtgaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgaagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17534 - RNA, 9876 nt, synthetic construct
  misc_feature 1..9876: note = derived and/or modified CDS sequence (opt4) from DENV-2__KU094070__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagtggctggaggacaagatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcagcatcgtgacctgcgccatgttcacctgcaagaagatcatgaagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggctacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgaccggcgtgatcatcacctggatcggcatgaacagcagaagcaccagcctgagcgtgagcctggtgctggtgggcgccgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagaggagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatggtgagaaagatggagaagtaccagctggccgtgaccatcatggccatcctgtgcgtgcccaacgccgtgatcctgcagaacgcctggaaggtgagctgcaccatcctggccgtggtgagcgtgagccccctgttcctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacgccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaaagctgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggagcagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgaccctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgttcctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagtgacctggggcaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17535 - RNA, 9876 nt, synthetic construct
  misc_feature 1..9876: note = derived and/or modified CDS sequence (opt4) from DENV-2__FM210215__SS-prME
  source 1..9876: mol_type = other RNA
agcgccggcatgatcgtgatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtggtgctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagaaggccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacagcctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagagcgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17536 - RNA, 9876 nt, synthetic construct
  misc_feature 1..9876: note = derived and/or modified CDS sequence (opt4) from DENV-2__FM210216__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccaccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17537 - RNA, 9876 nt, synthetic construct
  misc_feature 1..9876: note = derived and/or modified CDS sequence (opt4) from DENV-2__FM210217__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgaccacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccgtgggcaccacccacttccagagagccctgatcttcatcctgctggccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagccccatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccgccatgaccgacgacatcggcatcggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccaccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcgccgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcaaggaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggcacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17538 - RNA, 9876 nt, synthetic construct
  misc_feature 1..9876: note = derived and/or modified CDS sequence (opt4) from DENV-2__JX286524__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 17539 - RNA, 9876 nt, synthetic construct
  misc_feature 1..9876: note = derived and/or modified CDS sequence (opt4) from DENV-2__JX286520__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcatcgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 17540 - RNA, 9876 nt, synthetic construct
  misc_feature 1..9876: note = derived and/or modified CDS sequence (opt4) from DENV-2__JX286525__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 17541 - RNA, 9876 nt, synthetic construct
  misc_feature 1..9876: note = derived and/or modified CDS sequence (opt4) from DENV-2__KM279598__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaaccctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacgtgggcagagtgatggtgatggtgggcgccaccatgaccgacgacatcggcatgggcgtgacctacctggccctgctggccgccttcaagatcagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagaaggagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17542 - RNA, 9876 nt, synthetic construct
  misc_feature 1..9876: note = derived and/or modified CDS sequence (opt4) from DENV-2__KM279576__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaaccctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaagatcagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagaaggagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaacctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17543 - RNA, 9876 nt, synthetic construct
  misc_feature 1..9876: note = derived and/or modified CDS sequence (opt4) from DENV-2__KC964095__SS-prME
  source 1..9876: mol_type = other RNA
agcgccggcatgatcatcatgctgatccccaccgtgatggccttccacctgaccaccagaaacggcgagccccacatgatcgtgagcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgacagatggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggccccccccatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatcgtggacagaggctggggcaacggctgcggcagcttcggcaagggcggcatcgtgacctgcgccatgttcacctgcaagaagaacatggagggcaagatcgtgcagcccgagaacctggagtacaccatcgtggtgaccccccacagcggcgaggagcacgccatcggcaacgacaccggcaagcacggcaaggagatcaaggtgaccccccagagcagcgtgaccgaggccgagctgaccggctacggcaccgtgaccatcgagtgcagccccagaaccggcctggacttcaacgagatggtgctgctgcagatgggcaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcggcctgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgagaacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcaccatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcatgttcaccaccaacatctggctgcagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcaccagggcaagcccgagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggccctgaagatcgtgagagacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaactgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcgtgctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctgggcggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggagggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccagcagcccgagagcaacatcctggacatcgacctgccccccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagtggagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcggcaagatcaagcaggagcacgagaccagctggcactacgaccaggaccacccctacaagacctgggcctaccacggcagctacgagaccaagcagaccggcagcgccagcagcatggtggacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaaggagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccccccccagaggcaccgtgatggacatcatcagcagaagagaccagagaggcagcggccaggtggtgacctacggcctgaacaccttcaccaacatggaggcccagctgatcagacagatggagggcgagggcgtgttcaagaacatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacgtgggcaagatcagaaaggacatccagcagtgggagcccagcagaggctgggacgactggacccaggtgcccttctgcagccaccacagccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagagggccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17544 - RNA, 9876 nt, synthetic construct
  misc_feature 1..9876: note = derived and/or modified CDS sequence (opt4) from DENV-2__KC964094__SS-prME
  source 1..9876: mol_type = other RNA
agcgccggcatgatcatcatgctgatccccaccgtgatggccttccacctgaccaccagaaacggcgagccccacatgatcgtgagcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagaagcatcggcatcagcaacagagacttcgtggagggcgtgagcggcggcagctgggtggacgtggtgctggagcacggcagctgcgtgaccaccatggccaagaacaagcccaccctggacttcgagctgaccaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcgtgaccgaggccgagctgaccggctacggcaccgtgaccatggagtgcagccccagaaccggcctggacttcaacgagatggtgctgctgcagatgaagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaaccgacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaaggagagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcgtgaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagagacccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctggccggcagaagcgccgacctggagctggagagagccgccgacgtgagatgggaggagcaggccgagatcagcggcagcagccccatcctgagcatcaccatcagcgaggacggcggcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggagatccaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacaccttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcagaaaggtgatccagctgagcagaaagaccagcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgggcaaccccctgagcagaaacagcacccacgagatgtactgggccagcaacgccagcggcaacatcgtgagcagcgtgaacatgatcagcagaatgctgatcaacagattcaccatgagacacaagaaggccacctacgagcccgacgtggacctgggcagcggcaccagacacatcggcatcgagagcgagacccccaacctggacatcatcggcaagagaatcgagaagatcaagcaggagcacgagaccagctggcactgcgaccaggaccacccctacaagacctgggcctaccacggcagctacgaggccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaaggcccccagaatgtgcaccagagaggagttcaccagaaaggtgagaagcaacgccgccctgggcgccatgttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17545 - RNA, 9876 nt, synthetic construct
  misc_feature 1..9876: note = derived and/or modified CDS sequence (opt4) from DENV-2__KC964093__SS-prME
  source 1..9876: mol_type = other RNA
accgccggcgtgatcatcatgatgatccccaccgtggtggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgaccaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgtggtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggccgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcagcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcagcatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctggccggcagaagcgccgacctggagctggagagagccgccgacgtgagatgggaggagcaggccgagatcagcggcagcagccccatcctgagcatcaccatcagcgaggacggcggcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggagatccaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagagagtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacgacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggccatcgccatcctgaccgtggtggccgccaccatggccaacgagatgggcttcctggagaagaccaagaaggacttcggcctgggcagcatcgccacccagcagcccgagagcaacatcctggacctggacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgtgggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtgatggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcgccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctgaccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggagggcgaggccggcgtgctgtggtga

SEQ ID NO: 17546 - RNA, 9876 nt, synthetic construct
  misc_feature 1..9876: note = derived and/or modified CDS sequence (opt4) from DENV-2__DQ448231__SS-prME
  source 1..9876: mol_type = other RNA
accgccggcgtgatcatcatgctgatccccaccgccatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagaacaccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatcctgagcaccgagccccacaaccagaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccgtgctgctggtggccgtgagcttcatgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatgatcctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgagaaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacaccggcgagaccctgggcgagaagtggaagaacagactgaacagcctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagatcggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatgggcgcccagctgatcagacagatggagggcgagggcgtgttcaagggcatccagcacctgaccgccaccgaggaggtggccgtgcaggactggctggccagagtgggcagagagagactgagcagaatggccatcagcggcgacgactgcgtggtgaagcccctggacgacagattcgccagcgccctgaccgccctgaacgacatgggcaagatcagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagacacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcagcgaggagtacaccgactacatgcccagcatgaagagattcagaagagaggaggaggaggccggcgtgctgtggtga

SEQ ID NO: 17547 - RNA, 9876 nt, synthetic construct
  misc_feature 1..9876: note = derived and/or modified CDS sequence (opt4) from DENV-2__JX470186__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggcccacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagatgaaggagagacaggacgtgttctgcgacagcaagctgatgagcgccgccatcaaggacagcagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccaggccaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtggtgagcggcctgttccccgtgagcacccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagaacaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17548 - RNA, 9876 nt, synthetic construct
  misc_feature 1..9876: note = derived and/or modified CDS sequence (opt4) from DENV-2__KU517846__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcatgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagctgaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgagcccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcagactgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctggagagagtgggcagagagagactgagcagaatggccatcagcggcgacgactgcgtggtgaagcccctggacgacagattcgccagcgccctgaccgccctgaacgacatgggcaagatcagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17549 - RNA, 9876 nt, synthetic construct
  misc_feature 1..9876: note = derived and/or modified CDS sequence (opt4) from DENV-2__KJ830750__SS-prME
  source 1..9876: mol_type = other RNA
accgccggcgtgatcatcatgctgatccccaccgccatggccttccacctgaccaccagaaacggcgagccccacatgatcgtgagcaagcaggagaagggcaagagcctgctgttcaagaccgaggacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacatccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccggcaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgagcatcatgaccggcgacatcaagggcatcatgcaggccggcaagagaagcctgagaccccagcccaccgagctgaagtacagctggaagacctggggcaaggccaagatgctgagcaccgagccccacaaccagaccttcctgatcgacggccccgagaccgccgagtgccccaacaccaacagagcctggaacagcctggaggtggaggactacggcttcggcgtgttcaccaccaacatctggctgaagctgaaggagagacaggacgtgagctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccgtgctgctggtggccgtgagcttcatgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccacccccgagagcatcctggagctgaccgacgccctggccctgggcatgatgatcctgaagatcgtgagaaacatggagaagtaccagctggccgtgaccatcatggccatcctgtgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagaaggccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgagaaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccatccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcgtgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacaccggcgagaccctgggcgagaagtggaagaacagactgaacagcctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcgccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagatcggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatgggcgcccagctgatcagacagatggagggcgagggcgtgttcaagggcatccagcacctgaccgccaccgaggaggtggccgtgcaggactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccggccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccagaaacatccagaccgccatcaaccaggtgagaagcctgatcggcagcgaggagtacaccgactacatgcccagcatgaagagattcagaagagaggaggaggaggccggcgtgctgtggtga

SEQ ID NO: 17550 - RNA, 9876 nt, synthetic construct
  misc_feature 1..9876: note = derived and/or modified CDS sequence (opt4) from DENV-2__FM210231__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtggtgctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgtgacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagagcgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17551 - RNA, 9876 nt, synthetic construct
  misc_feature 1..9876: note = derived and/or modified CDS sequence (opt4) from DENV-2__FM210239__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccgtgggcaccacccacttccagagagccctgatcttcatcctgctggccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagccccatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtgaccgtgagcttcgtgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcgccgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaagaaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcgtgaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaaggacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17552 - RNA, 9876 nt, synthetic construct
  misc_feature 1..9876: note = derived and/or modified CDS sequence (opt4) from DENV-2__FM210232__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccgtgggcaccacccacttccagagagccctgatcttcatcctgctggccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagccccatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggcctgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtgaccgtgagcttcgtgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcgccgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcgtgaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaaggacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17553 - RNA, 9876 nt, synthetic construct
  misc_feature 1..9876: note = derived and/or modified CDS sequence (opt4) from DENV-2__FM210233__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatggagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagagagacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcacaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17554 - RNA, 9876 nt, synthetic construct
  misc_feature 1..9876: note = derived and/or modified CDS sequence (opt4) from DENV-2__FM210241__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgccatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgagcctgatcgcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagagactggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagttcatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17555 - RNA, 9876 nt, synthetic construct
  misc_feature 1..9876: note = derived and/or modified CDS sequence (opt4) from DENV-2__FM210242__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtggtgctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagagcgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17556 - RNA, 9876 nt, synthetic construct
  misc_feature 1..9876: note = derived and/or modified CDS sequence (opt4) from DENV-2__FM210243__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccgtgggcaccacccacttccagagagccctgatcttcatcctgctggccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtgaccgtgagcttcgtgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgttccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcgccgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17557 - RNA, 9876 nt, synthetic construct
  misc_feature 1..9876: note = derived and/or modified CDS sequence (opt4) from DENV-2__FM210244__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccgtgggcaccacccacttccagagagccctgatcttcatcctgctggccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagccccatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccgccatgaccgacgacatcggcatcggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccaccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcgccgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcaaggaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcaaggcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggcacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17558 - RNA, 9876 nt, synthetic construct
  misc_feature 1..9876: note = derived and/or modified CDS sequence (opt4) from DENV-2__FM210234__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccgtgggcaccacccacttccagagagccctgatcttcatcctgctggccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagccccatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccggcaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatcgccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccaccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcgccgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggcacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17559 - RNA, 9876 nt, synthetic construct
  misc_feature 1..9876: note = derived and/or modified CDS sequence (opt4) from DENV-2__FM210213__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccgtgggcaccacccacttccagagagccctgatcttcatcctgctggccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagccccatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccaccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcgccgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggcacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17560 - RNA, 9876 nt, synthetic construct
  misc_feature 1..9876: note = derived and/or modified CDS sequence (opt4) from DENV-2__FM210235__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccgtgggcaccacccacttccagagagccctgatcttcatcctgctggccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcagacacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagccccatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtgaccgtgagcttcgtgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggagtggagcatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcgccgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccaccagagagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcgtgaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17561 - RNA, 9876 nt, synthetic construct
  misc_feature 1..9876: note = derived and/or modified CDS sequence (opt4) from DENV-2__FM210205__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgaagaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17562 - RNA, 9876 nt, synthetic construct
  misc_feature 1..9876: note = derived and/or modified CDS sequence (opt4) from DENV-2__FM210206__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccctgatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcatcgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17563 - RNA, 9876 nt, synthetic construct
  misc_feature 1..9876: note = derived and/or modified CDS sequence (opt4) from DENV-2__FM210246__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagcttcaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgaagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17564 - RNA, 9876 nt, synthetic construct
  misc_feature 1..9876: note = derived and/or modified CDS sequence (opt4) from DENV-2__FM210207__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagaacgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatgcacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17565 - RNA, 9876 nt, synthetic construct
  misc_feature 1..9876: note = derived and/or modified CDS sequence (opt4) from DENV-2__FM210238__SS-prME
  source 1..9876: mol_type = other RNA
accgccggcatgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccgtgggcaccacccacttccagagagccctgatcttcatcctgctggccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagccccatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtgaccgtgagcttcgtgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcgccgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacgaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17566 - RNA, 9876 nt, synthetic construct
  misc_feature 1..9876: note = derived and/or modified CDS sequence (opt4) from DENV-2__FM210224__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgccatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgccaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctgatcgcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagagactggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17567 - RNA, 9876 nt, synthetic construct
  misc_feature 1..9876: note = derived and/or modified CDS sequence (opt4) from DENV-2__FM210225__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgccatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctgatcgcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagagactggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17568 - RNA, 9876 nt, synthetic construct
  misc_feature 1..9876: note = derived and/or modified CDS sequence (opt4) from DENV-2__FM210226__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccgtgggcaccacccacttccagagagccctgatcttcatcctgctggccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagccccatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccgccatgaccgacgacatcggcatcggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccaccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcgccgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggcacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccgtgcccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17569 - RNA, 9876 nt, synthetic construct
  misc_feature 1..9876: note = derived and/or modified CDS sequence (opt4) from DENV-2__FM210227__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcgtgaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgccatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcaccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatgatcctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacttcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcgtggccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgggcggcgagcacaagagactggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcaagggctggaacgactggacccaggtgcccttctgcagccaccacttccacgacctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17570 - RNA, 9876 nt, synthetic construct
  misc_feature 1..9876: note = derived and/or modified CDS sequence (opt4) from DENV-2__FM210204__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcgtgaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgccatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcctacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggcctggagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcgtggccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgccccccgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagagactggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcaagggctggaacgactggacccaggtgcccttctgcagccaccacttccacgacctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17571 - RNA, 9876 nt, synthetic construct
  misc_feature 1..9876: note = derived and/or modified CDS sequence (opt4) from DENV-2__FM210230__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccgtgggcaccacccacttccagagagccctgatcttcatcctgctggccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagccccatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtgaccgtgagcttcgtgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccatgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcgccgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcgtgaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaaggacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatctgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaagggcggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagagactgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17572 - RNA, 9876 nt, synthetic construct
  misc_feature 1..9876: note = derived and/or modified CDS sequence (opt4) from DENV-2__KC762665__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtgacccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccacaccttcctgatcgacggccccgagaccgccgagtgccccaacgccaacagagcctggaacagcctggaggtggaggactacggcttcggcgtgttcaccaccaacatctggctgaagctgaaggagagacaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccagcaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacttcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtggcccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17573 - RNA, 9876 nt, synthetic construct
  misc_feature 1..9876: note = derived and/or modified CDS sequence (opt4) from DENV-2__KC762669__SS-prME
  source 1..9876: mol_type = other RNA
accgccggcatcatcatcatggtgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcatcatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacttcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagctggagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagagactggccgaggccatcttcagactgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17574 - RNA, 9876 nt, synthetic construct
  misc_feature 1..9876: note = derived and/or modified CDS sequence (opt4) from DENV-2__KC762658__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgcccccggcgagcacagaagagagaagagaagcgtggccctggtgccccacgtgggcatgggcctggagaccagaaccgagacctggatgagcagcgagggcgccggcaagcacgcccagagaatcgagacctgggtgctgagacaccccggcttcaccatcatggccgccatcctggcctacaccatcggcaccacctacttccagagagtgctgatcttcatcctgctgaccgccgtgacccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagctgcccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacttcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggagctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgagaagtacaccgactacatgcccagcatgaagagattcagaagagaggaggaggaggccggcgtgctgtggtga

SEQ ID NO: 17575 - RNA, 9876 nt, synthetic construct
  misc_feature 1..9876: note = derived and/or modified CDS sequence (opt4) from DENV-2__KC762660__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtgacccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcatcgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacttcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgcaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17576 - RNA, 9876 nt, synthetic construct
  misc_feature 1..9876: note = derived and/or modified CDS sequence (opt4) from DENV-2__KC762676__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgtactgcgacagcaagctgatgagcgccgccatcaaggacaacagagccgtgcacgccgacatgggctactggatcgagagcgccctgaacgacacctggaagatcgagaaggccagcttcatcgaggtgaagagctgctactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggccctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacttcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgagcctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacagaacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgagagtgggcagagagagactgagcagaatggccatcagcggcgacgactgcgtggtgaagcccctggacgacagattcgccaacgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17577 - RNA, 9876 nt, synthetic construct
  misc_feature 1..9876: note = derived and/or modified CDS sequence (opt4) from DENV-2__KC762662__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtgacccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccacaccttcctgatcgacggccccgagaccgccgagtgccccaacgccaacagagcctggaacagcctggaggtggaggactacggcttcggcgtgttcaccaccaacatctggctgaagctgaaggagagacaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccagcaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacttcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgaccgtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17578 - RNA, 9876 nt, synthetic construct
  misc_feature 1..9876: note = derived and/or modified CDS sequence (opt4) from DENV-2__KC762661__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtgacccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccacaccttcctgatcgacggccccgagaccgccgagtgccccaacgccaacagagcctggaacagcctggaggtggaggactacggcttcggcgtgttcaccaccaacatctggctgaagctgaaggagagacaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccagacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccagcaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacttcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17579 - RNA, 9876 nt, synthetic construct
  misc_feature 1..9876: note = derived and/or modified CDS sequence (opt4) from DENV-2__KC762655__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtgacccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccgtgtacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacaaggccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccaccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacttcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaagcctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcatcgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccagaaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17580 - RNA, 9876 nt, synthetic construct
  misc_feature 1..9876: note = derived and/or modified CDS sequence (opt4) from DENV-2__KC762656__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagagccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtgacccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcaccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccagtggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtggtgagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacttcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17581 - RNA, 9876 nt, synthetic construct
  misc_feature 1..9876: note = derived and/or modified CDS sequence (opt4) from DENV-2__KC762673__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcacccccctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgtactgcgacagcaagctgatgagcgccgccatcaaggacaacagagccgtgcacgccgacatgggctactggatcgagagcgccctgaacgacacctggaagatcgagaaggccagcttcatcgaggtgaagagctgctactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggccctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacttcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacagaacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17582 - RNA, 9876 nt, synthetic construct
  misc_feature 1..9876: note = derived and/or modified CDS sequence (opt4) from DENV-2__KC762663__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtgacccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccacaccttcctgatcgacggccccgagaccgccgagtgccccaacgccaacagagcctggaacagcctggaggtggaggactacggcttcggcgtgttcaccaccaacatctggctgaagctgaaggagagacaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccagcaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacttcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgaccgtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17583 - RNA, 9876 nt, synthetic construct
  misc_feature 1..9876: note = derived and/or modified CDS sequence (opt4) from DENV-2__KC762675__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgtactgcgacagcaagctgatgagcgccgccatcaaggacaacagagccgtgcacgccgacatgggctactggatcgagagcgccctgaacgacacctggaagatcgagaaggccagcttcatcgaggtgaagagctgctactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggccctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacttcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatccagcaggagcacgagaccagctggcactacgaccaggaccacccctacagaacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaaggaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17584 - RNA, 9876 nt, synthetic construct
  misc_feature 1..9876: note = derived and/or modified CDS sequence (opt4) from DENV-2__KC762671__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacagcagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccaggccaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacttcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcgccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcatgaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17585 - RNA, 9876 nt, synthetic construct
  misc_feature 1..9876: note = derived and/or modified CDS sequence (opt4) from DENV-2__KC762664__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtgacccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcaccgacctggagaagagacacggcctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccacaccttcctgatcgacggccccgagaccgccgagtgccccaacgccaacagagcctggaacagcctggaggtggaggactacggcttcggcgtgttcaccaccaacatctggctgaagctgaaggagagacaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccagcaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcaaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacttcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgaccgtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtgggcagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17586 - RNA, 9876 nt, synthetic construct
  misc_feature 1..9876: note = derived and/or modified CDS sequence (opt4) from DENV-2__KC762674__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgtactgcgacagcaagctgatgagcgccgccatcaaggacaacagagccgtgcacgccgacatgggctactggatcgagagcgccctgaacgacacctggaagatcgagaaggccagcttcatcgaggtgaagagctgctactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggccctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacttcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17587 - RNA, 9876 nt, synthetic construct
  misc_feature 1..9876: note = derived and/or modified CDS sequence (opt4) from DENV-2__KC762672__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctgggagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacagcagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccaggccaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacttcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacgccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcgccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcatgaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17588 - RNA, 9876 nt, synthetic construct
  misc_feature 1..9876: note = derived and/or modified CDS sequence (opt4) from DENV-2__KC762667__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtgacccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccacaccttcctgatcgacggccccgagaccgccgagtgccccaacgccaacagagcctggaacagcctggaggtggaggactacggcttcggcgtgttcaccaccaacatctggctgaagctgaaggagagacaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcgtgaccctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccagcaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacttcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagagagagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17589 - RNA, 9876 nt, synthetic construct
  misc_feature 1..9876: note = derived and/or modified CDS sequence (opt4) from DENV-2__KC762659__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtgacccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatggagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaagactgaccagcaaggagctgatgatgaccaccatcggcatcgtgctgctgagccagagcaccatccccgagaccatcctggagctgaccgacgccctggccctgggcatgatggtgctgaagatcgtgagaaagatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacttcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagagcgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgccaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatcgaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17590 - RNA, 9876 nt, synthetic construct
  misc_feature 1..9876: note = derived and/or modified CDS sequence (opt4) from DENV-2__KC762657__SS-prME
  source 1..9876: mol_type = other RNA
accgccggcatcatcatcatgatgatccccaccgtgatggtgttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtgacccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatggagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaagactgaccagcaaggagctgatgatgaccaccatcggcatcgtgctgctgagccagagcaccatccccgagaccatcctggagctgaccgacgccctggccctgggcatgatggtgctgaagatcgtgagaaagatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacttcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagagcgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgccaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatcgaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17591 - RNA, 9876 nt, synthetic construct
  misc_feature 1..9876: note = derived and/or modified CDS sequence (opt4) from DENV-2__KC762666__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtgacccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccacaccttcctgatcgacggccccgagaccgccgagtgccccaacgccaacagagcctggaacagcctggaggtggaggactacggcttcggcgtgttcaccaccaacatctggctgaagctgaaggagagacaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccagcaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacttcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagagagagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17592 - RNA, 9876 nt, synthetic construct
  misc_feature 1..9876: note = derived and/or modified CDS sequence (opt4) from DENV-2__KC762677__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgtactgcgacagcaagctgatgagcgccgccatcaaggacaacagagccgtgcacgccgacatgggctactggatcgagagcgccctgaacgacacctggaagatcgagaaggccagcttcatcgaggtgaagagctgctactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccatgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggccctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacttcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacagaacctgggcctaccacggcagctacgagaacaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagaaaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17593 - RNA, 9876 nt, synthetic construct
  misc_feature 1..9876: note = derived and/or modified CDS sequence (opt4) from DENV-2__KC762668__SS-prME
  source 1..9876: mol_type = other RNA
accgccggcatcatcatcatggtgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcatcatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacttcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagctggagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagagactggccgaggccatcttcagactgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17594 - RNA, 9876 nt, synthetic construct
  misc_feature 1..9876: note = derived and/or modified CDS sequence (opt4) from DENV-2__KC762678__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagaatcctgatcttcatcctgctgaccgccgtgacccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccacaccttcctgatcgacggccccgagaccgccgagtgccccaacgccaacagagcctggaacagcctggaggtggaggactacggcttcggcgtgttcaccaccaacatctggctgaagctgaaggagagacaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatcggcgtgacctacctggccctgctggccgccttcaaggtgagacccaccttcgccgccggcctgctgctgagaaagctgaccagcaaggagctgatgatgaccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccagcaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggtgagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgagcccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgaccgtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17595 - RNA, 9876 nt, synthetic construct
  misc_feature 1..9876: note = derived and/or modified CDS sequence (opt4) from DENV-2__KC762679__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacagcagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccaggccaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcatgaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17596 - RNA, 9876 nt, synthetic construct
  misc_feature 1..9876: note = derived and/or modified CDS sequence (opt4) from DENV-2__KC762680__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacagcagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccaggccaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacttcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcatgaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgaagggcaacgaggagtacaccgactacatgcccagcatgaagagattcagaagagaggagggcgaggccggcgtgctgtggtga

SEQ ID NO: 17597 - RNA, 9876 nt, synthetic construct
  misc_feature 1..9876: note = derived and/or modified CDS sequence (opt4) from DENV-2__JQ955624__SS-prME
  source 1..9876: mol_type = other RNA
accgccggcgtgatcatcatgctgatccccaccgccatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcgccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccaccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccgtgaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcatcctgggcatggccctgttcctggaggagatgctgagaaccagagtgggcaccaagcacgccgtgctgctggtggccgtgagcttcatgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgagaaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagagcgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggagctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcttcggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacaccggcgagaccctgggcgagaagtggaagaacagactgaacagcctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtgatggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagatgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatgggcgcccagctgatcagacagatggagggcgagggcgtgttcaagagcatccagcacctgaccaccaccgaggaggtggccgtgcaggactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagacacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcagcgaggagtacaccgactacatgcccagcatgaagagattcagaagagaggaggaggaggccggcgtgctgtggtga

SEQ ID NO: 17598 - RNA, 9876 nt, synthetic construct
  misc_feature 1..9876: note = derived and/or modified CDS sequence (opt4) from DENV-2__KJ918750__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccaaggacggcaccaacatgtgcaccctgatggccatggacctgggcgagctgtgcgaggacaccatcacctacaagtgccccttcctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagatctggatcctgagacaccccggcttcaccatcatggccgccatcctggcctacaccatcggcaccacccacttccagagagtgctgatcttcatcctgctgaccgccatcgcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgacagcagatgccccacccagggcgagcccaccctgaacgaggagcaggacaagagattcgtgtgcaagcacagcatggtggacagaggctggggcaacggctgcggcctgttcggcaagggcggcatcgtgacctgcgccatgttcacctgcaagaagatcatgaagggcaagatcgtgcagcccgagaacctggagtacaccgtggtgatcaccccccacagcggcgaggagcacgccgtgggcaacgacaccggcaagcacggcaaggaggtgaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgctggagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgaccggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcgtgaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggtgggcaagagaagcctgagaccccagcccaccgagctgagatacagctggaagacctggggcaaggccaagatgctgagcaccgagctgcacaaccagaccttcctgatcgacggccccgagaccgccgagtgccccaacaccaacagagcctggaacagcctggaggtggaggactacggcttcggcgtgttcaccaccaacatctggctgagactgagagagaagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcgacggcgtgctggagagcgagatggtgatccccaagaacttcgccggccccgtgagccagcacaacaacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgagcagcctggtgaccgccggccacggccagatcgacaacttcagcctgggcatcctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcagcatccccgagaccatcctggagctgaccgacgccctggccctgggcatgatggtgctgaagatggtgagaaacatggagaagtaccagctggccgtgaccatcatggccatcctgtgcgtgcccaacgccgtgatcctgcagaacgcctggaaggtgagctgcaccatcctggccctggtgagcgtgagccccctgttcctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggacgaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaagaccggcaacgacatcgccgcctgcctgagaaagaacggcaagagagtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcaccagaaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcaaggcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtgcgcccagatccagccccactggatcgccgccagcatcatcctggagttcttcctgatcgtgctgctgatccccgagcccgagaagcagagaaccccccaggacaaccagctgacctacgtgatcatcgccatcctgaccgtggtggccgccaccatggccaacgagatgggcttcctggagaagaccaagaaggacctgggcctgggcaacatcgtgacccagcagcccgagagcaacatcctggacatcgacctgagacccgccagcgcctggaccctgtacgccgtggccaccaccttcatcacccccatgctgagacacagcatcgagaacagcagcgtgaacatgagcctgaccgccatcgccaaccaggccaccgtgctgatgggcctgggcaagggctggcccctgagcaagatggacatcggcgtgcccctgctggccatcggctgctgcagccaggtgaaccccatcaccctgaccgccgccctgttcctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatcatgagaaccacctgggccctgtgcgaggccctgaccctggccaccggccccgtgagcaccctgtgggagggcaaccccggcagattctggaacaccaccatcgccgtgagcatggccaacatcttcagaggcagctacctggccggcgccggcctgctgttctgcatcatgaacaacaccaccagactgagaagaggcaccggccacctgagaaagaccctgggcgacaagtgcaagagcagactgaacaccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccatcgaggacctgaagaacgaggagatgatcaccaaccacatggccggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcaggactggctggccagagtgggcagagagagactgagcagaatggccatcagcggcgacgactgcgtggtgaagcccctggacgacagattcgccagagccctgaccgccctgaacgacatgggcaaggtgagaaaggacatccagcagtgggagcccagcagaggctggaacgactggacccaggtgcccttctgcagccaccacttccacgagctgatcatgaaggacggcagaaccctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17599 - RNA, 9876 nt, synthetic construct
  misc_feature 1..9876: note = derived and/or modified CDS sequence (opt4) from DENV-2__KU517845__SS-prME
  source 1..9876: mol_type = other RNA
accgccggcatcatcatcatgatgatccccaccgtgatcgccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcgcctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtgacccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatggccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgccttctgcgacagcaagctgatgagcgccgccatcaaggacaacagagccatccacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggtgctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccgtgagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccaaccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagatcatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccagccacatgaagggcgagcacagaaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17600 - RNA, 9876 nt, synthetic construct
  misc_feature 1..9876: note = derived and/or modified CDS sequence (opt4) from DENV-2__KU517847__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaaggtgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgagctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgagaactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccgccctggccgtggtgagcgtgagccccctgctgctgaccagcagccagcagaagaccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcttcctgaagaacgacatccccatgaccggccccctggtggccggcggcctgctgaccgtgtgctacgtgctgaccggcagaagcgccgacctggagctggagagagccgccgacatcagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgccagcatccccatcaccgccgccgcctggtacctgtgggaggtgaagaagcagagagccggcgtgctgtgggacgtgcccagccccccccccgtgggcagagccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcgtgaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaagatacggcggcgccctggtgagaaacccccccagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcagactgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgccaccgaggagatcgccgtgaagaactggctggtgagagtgggcagagagagactgagcagaatggccatcagcggcgacgactgcgtggtgaagcccttcgacgacagattcgccaacgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17601 - RNA, 9876 nt, synthetic construct
  misc_feature 1..9876: note = derived and/or modified CDS sequence (opt4) from DENV-2__JQ955623__SS-prME
  source 1..9876: mol_type = other RNA
accgccggcatgatcatcatgctgatccccaccgccatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagccccacaaccagaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccgtgctgctggtggccgtgagcttcatgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatgatcctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgagaaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagctggagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacaccggcgagaccctgggcgagaagtggaagaacagactgaacagcctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacgacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtgaacaaggagagaaacctgcacctggagggcaagtgcgagacctgcgtgtacaacatgatgggcaagagagagaagaagatcggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatgggcgcccagctgatcagacagatggagggcgagggcgtgttcaagggcatccagcacctgaccgccaccgaggagaccgccgtgcacgactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagacacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcagcgaggagtacaccgactacatgcccagcatgaagagattcagaagagaggaggaggaggccggcgtgctgtggtga

SEQ ID NO: 17602 - RNA, 9876 nt, synthetic construct
  misc_feature 1..9876: note = derived and/or modified CDS sequence (opt4) from DENV-2__KR779782__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgagcagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17603 - RNA, 9876 nt, synthetic construct
  misc_feature 1..9876: note = derived and/or modified CDS sequence (opt4) from DENV-2__KM279608__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgtgaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacctgcagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacaaccccgtgaacatcgaggccgagccccccttcggcgacagctacatcatcatcggcgtggagcccggccagctgaagctgagctggtacaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggagaaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctggagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcaagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17604 - RNA, 9876 nt, synthetic construct
  misc_feature 1..9876: note = derived and/or modified CDS sequence (opt4) from DENV-2__KM279605__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacaaccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctggagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17605 - RNA, 9876 nt, synthetic construct
  misc_feature 1..9876: note = derived and/or modified CDS sequence (opt4) from DENV-2__KM279609__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17606 - RNA, 9876 nt, synthetic construct
  misc_feature 1..9876: note = derived and/or modified CDS sequence (opt4) from DENV-2__KM279607__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacctgcagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacaaccccgtgaacatcgaggccgagccccccttcggcgacagctacatcatcatcggcgtggagcccggccagctgaagctgagctggtacaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctggagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17607 - RNA, 9876 nt, synthetic construct
  misc_feature 1..9876: note = derived and/or modified CDS sequence (opt4) from DENV-2__KM279606__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacaaccccgtgaacatcgaggccgagccccccttcggcgacagctacatcatcatcggcgtggagcccggccagctgaagctgagctggtacaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctggagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggccgagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17608 - RNA, 9876 nt, synthetic construct
  misc_feature 1..9876: note = derived and/or modified CDS sequence (opt4) from DENV-2__JN851113__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17609 - RNA, 9876 nt, synthetic construct
  misc_feature 1..9876: note = derived and/or modified CDS sequence (opt4) from DENV-2__GU370050__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatcctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacaagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcagactgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17610 - RNA, 9876 nt, synthetic construct
  misc_feature 1..9876: note = derived and/or modified CDS sequence (opt4) from DENV-2__JN851129__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgagcgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacctgtggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagagcttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacatcatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagaccctggtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17611 - RNA, 9876 nt, synthetic construct
  misc_feature 1..9876: note = derived and/or modified CDS sequence (opt4) from DENV-2__JN851128__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaaccaccccgccaccctgagaaagtactgcatcgaggccaagctgaccaacaccaccaccgccagcagatgccccacccagggcgagcccagcctgagcgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacctgtggctgaagctgaaggagagacaggacgtgttctgcgacagcaagctgatgagcgccgccatcaaggacaacagagccgtgcacgccgacatgggctactggatcgagagcgccatcaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatgatcctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacatcatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagaccctggtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17612 - RNA, 9876 nt, synthetic construct
  misc_feature 1..9876: note = derived and/or modified CDS sequence (opt4) from DENV-2__JN851130__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgctactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggccctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17613 - RNA, 9876 nt, synthetic construct
  misc_feature 1..9876: note = derived and/or modified CDS sequence (opt4) from DENV-2__JN851125__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgaagcagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccgtgatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagatgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgagctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaaggtggtgagaaacatggagaagtaccagctggccgtgaccatcatggccatcctgtgcgtgcccaacgccgtgatcctgcagaacgcctggaaggtgagctgcaccaccctggccgtggtgagcgtgttccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagagcgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcagcaccacccagcagcacgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgagcctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgccaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17614 - RNA, 9876 nt, synthetic construct
  misc_feature 1..9876: note = derived and/or modified CDS sequence (opt4) from DENV-2__JN851123__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgaagcagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgagatcaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcatcgagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcagactgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccatcgagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17615 - RNA, 9876 nt, synthetic construct
  misc_feature 1..9876: note = derived and/or modified CDS sequence (opt4) from DENV-2__JN851118__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17616 - RNA, 9876 nt, synthetic construct
  misc_feature 1..9876: note = derived and/or modified CDS sequence (opt4) from DENV-2__JN851124__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgaagcagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgatgagacaccccggcttcaccgtgatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagatgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgagctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaaggtggtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagagcgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcagcaccacccagcagcacgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgagcctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggtgacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgccaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17617 - RNA, 9876 nt, synthetic construct
  misc_feature 1..9876: note = derived and/or modified CDS sequence (opt4) from DENV-2__JN851114__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17618 - RNA, 9876 nt, synthetic construct
  misc_feature 1..9876: note = derived and/or modified CDS sequence (opt4) from DENV-2__JN851126__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgaagcagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgagatcaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacaccatcctgctggtggccgtgagcttcgtgaccctgatcaccggcaacatgagcttcagagacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccgccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagaaggagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcgtgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagacctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagcacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcagactgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17619 - RNA, 9876 nt, synthetic construct
  misc_feature 1..9876: note = derived and/or modified CDS sequence (opt4) from DENV-2__JN851121__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccaaccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17620 - RNA, 9876 nt, synthetic construct
  misc_feature 1..9876: note = derived and/or modified CDS sequence (opt4) from DENV-2__JN851115__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggctgctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagagcgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggctacgaggagtacaccgactacatgcccagcatgaagagattcagaagagaggaggaggaggccggcgtgctgtggtga

SEQ ID NO: 17621 - RNA, 9876 nt, synthetic construct
  misc_feature 1..9876: note = derived and/or modified CDS sequence (opt4) from DENV-2__JN851127__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgaagcagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgagcgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgagatcaagctgaccatcatgaccggcgacatcaagggcatcatgcaggccggcaagagaagcctgagaccccagcccatcgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgtgatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagcagacagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcatcgagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagagaaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgtgcacaagaagctggccgaggccatcttcagactgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccatcgagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17622 - RNA, 9876 nt, synthetic construct
  misc_feature 1..9876: note = derived and/or modified CDS sequence (opt4) from DENV-2__JN851120__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccgtgggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaatcgaggaggaggaggccggcgtgctgtggtga

SEQ ID NO: 17623 - RNA, 9876 nt, synthetic construct
  misc_feature 1..9876: note = derived and/or modified CDS sequence (opt4) from DENV-2__JN851131__SS-prME
  source 1..9876: mol_type = other RNA
accgccggcgtgatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatcgacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggaggtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccagcaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagtggagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtggatcaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccatccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagaagcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtgaacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17624 - RNA, 9876 nt, synthetic construct
  misc_feature 1..9876: note = derived and/or modified CDS sequence (opt4) from DENV-2__JN851122__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaagaccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtgacccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacatcggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17625 - RNA, 9876 nt, synthetic construct
  misc_feature 1..9876: note = derived and/or modified CDS sequence (opt4) from DENV-2__JN851116__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17626 - RNA, 9876 nt, synthetic construct
  misc_feature 1..9876: note = derived and/or modified CDS sequence (opt4) from DENV-2__GU370051__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctggagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgacatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgacaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaccccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcggcaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtggagaactggctgatgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17627 - RNA, 9876 nt, synthetic construct
  misc_feature 1..9876: note = derived and/or modified CDS sequence (opt4) from DENV-2__EU359009__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccatcgcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccttcccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacaccgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcagactgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17628 - RNA, 9876 nt, synthetic construct
  misc_feature 1..9876: note = derived and/or modified CDS sequence (opt4) from DENV-2__KC131142__SS-prME
  source 1..9876: mol_type = other RNA
accgccggcatcatcatcatggtgatccccaccgtgatggccttccacctgaccaccagaaacggcgagccccacatgatcgtgagcagacaggagaagggcaagagcctgctgttcaagaccgagaacggcctgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccatcgcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaacctggagatcgaggacgacatcttcagaaagaagagactgaccgtgatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacaccgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgaagctgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagaggcgccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgtgcacaagaagctggccgaggccatcttcagactgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17629 - RNA, 9876 nt, synthetic construct
  misc_feature 1..9876: note = derived and/or modified CDS sequence (opt4) from DENV-2__AY858035__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtggtgagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacaccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagaccagaagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggagagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17630 - RNA, 9873 nt, synthetic construct
  misc_feature 1..9873: note = derived and/or modified CDS sequence (opt4) from DENV-2__JX567951__SS-prME
  source 1..9873: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtgg

SEQ ID NO: 17631 - RNA, 9873 nt, synthetic construct
  misc_feature 1..9873: note = derived and/or modified CDS sequence (opt4) from DENV-2__JX567950__SS-prME
  source 1..9873: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcgaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcgtgaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcagcgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgaacgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaagtacctgggcctgggcagcatcaccacccaggagagcgagagcaacatcctggacatcgacctgagacccgccagcgcctggaccctgtacgccgtggccaccaccttcgtgacccccatgctgagacacagcatcgtgaacagcagcgtgaacgtgaccctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagaacgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggccgagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtgg

SEQ ID NO: 17632 - RNA, 9873 nt, synthetic construct
  misc_feature 1..9873: note = derived and/or modified CDS sequence (opt4) from DENV-2__HQ012538__SS-prME
  source 1..9873: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcgccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcgaggagatcaagatcaccccccagagcagcatcaccgaggccgagctgaccggctacggcaccgtgaccatggagtgcagccccagaaccggcctggacttcaacgagatggtgctgctgcagatggaggagaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgtgaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgctgaacgcctggaaggtgagctgcaccatcctggccgccgtgagcgtgagccccctgctgctgaccagcagccagcagaagaccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtgg

SEQ ID NO: 17633 - RNA, 9873 nt, synthetic construct
  misc_feature 1..9873: note = derived and/or modified CDS sequence (opt4) from DENV-2__HQ012533__SS-prME
  source 1..9873: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcgccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcgaggagatcaagatcaccccccagagcagcatcaccgaggccgagctgaccggctacggcaccgtgaccatggagtgcagccccagaaccggcctggacttcaacgagatggtgctgctgcagatggaggagaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgtgaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgctgaacgcctggaaggtgagctgcaccatcctggccgccgtgagcgtgagccccctgctgctgaccagcagccagcagaagaccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtgg

SEQ ID NO: 17634 - RNA, 9873 nt, synthetic construct
  misc_feature 1..9873: note = derived and/or modified CDS sequence (opt4) from DENV-2__HQ012534__SS-prME
  source 1..9873: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcgccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcgaggagatcaagatcaccccccagagcagcatcaccgaggccgagctgaccggctacggcaccgtgaccatggagtgcagccccagaaccggcctggacttcaacgagatggtgctgctgcagatggaggagaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatgctgggcgtgcccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgctgaacgcctggaaggtgagctgcaccatcctggccgccgtgagcgtgagccccctgctgctgaccagcagccagcagaagaccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtgg

SEQ ID NO: 17635 - RNA, 9873 nt, synthetic construct
  misc_feature 1..9873: note = derived and/or modified CDS sequence (opt4) from DENV-2__HQ012535__SS-prME
  source 1..9873: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcgccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcgaggagatcaagatcaccccccagagcagcatcaccgaggccgagctgaccggctacggcaccgtgaccatggagtgcagccccagaaccggcctggacttcaacgagatggtgctgctgcagatggaggagaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgtgaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgctgaacgcctggaaggtgagctgcaccatcctggccgccgtgagcgtgagccccctgctgctgaccagcagccagcagaagaccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggccgagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtgg

SEQ ID NO: 17636 - RNA, 9873 nt, synthetic construct
  misc_feature 1..9873: note = derived and/or modified CDS sequence (opt4) from DENV-2__HQ012536__SS-prME
  source 1..9873: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcgccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggagaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagactggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccggcaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacggcacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtgatggtgatggtgggcgtggccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgctgaacgcctggaaggtgagctgcaccatcctggccgccgtgagcgtgagccccctgctgctgaccagcagccagcagaagaccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatgggcgacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtgg

SEQ ID NO: 17637 - RNA, 9873 nt, synthetic construct
  misc_feature 1..9873: note = derived and/or modified CDS sequence (opt4) from DENV-2__HQ012537__SS-prME
  source 1..9873: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcgccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggagaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgtgaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgagaatcgtgagaaacatggagaagtaccagctggccgtgaccatcatggccatcagctgcgtgcccaacgccgtgatcctgctgaacgcctggaaggtgagctgcaccatcctggccgccgtgagcgtgagccccctgctgctgaccagcagccagcagaagaccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaagcacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggccgagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtgg

SEQ ID NO: 17638 - RNA, 9876 nt, synthetic construct
  misc_feature 1..9876: note = derived and/or modified CDS sequence (opt4) from DENV-2__KU365901__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccaggagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagaagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgcaactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgagttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgaccttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggagagtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcagaaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaccgaggagatcgccgtgaagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17639 - RNA, 9876 nt, synthetic construct
  misc_feature 1..9876: note = derived and/or modified CDS sequence (opt4) from DENV-2__GQ398258__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccagaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgaccccaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacaagggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgaagaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccaccagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagacacgagtggatgaccaccgaggacatgctgaccgtgtggaacagagtgtgggtgcaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17640 - RNA, 9876 nt, synthetic construct
  misc_feature 1..9876: note = derived and/or modified CDS sequence (opt4) from DENV-2__GQ398259__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccagaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacaagggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgaagaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccaccagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagacacgagtggatgaccaccgaggacatgctgaccgtgtggaacagagtgtgggtgcaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17641 - RNA, 9876 nt, synthetic construct
  misc_feature 1..9876: note = derived and/or modified CDS sequence (opt4) from DENV-2__GQ398268__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatggtgagaaagatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacgccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaaagctgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggagcagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17642 - RNA, 9876 nt, synthetic construct
  misc_feature 1..9876: note = derived and/or modified CDS sequence (opt4) from DENV-2__GQ398263__SS-prME
  source 1..9876: mol_type = other RNA
accgccggcatgatcatcatgatgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccacaccttcctgatcgacggccccgagaccgccgagtgccccaccaccaacagagcctggaacagcctggaggtggaggactacggcttcggcgtgttcaccaccaacatctggctgaagctgaaggagagacaggacgtgctgtgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggacaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgagaaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacgtgatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatctacaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17643 - RNA, 9876 nt, synthetic construct
  misc_feature 1..9876: note = derived and/or modified CDS sequence (opt4) from DENV-2__GQ398264__SS-prME
  source 1..9876: mol_type = other RNA
accgccggcatgatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggatgatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcagctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgagaaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcaccgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17644 - RNA, 9876 nt, synthetic construct
  misc_feature 1..9876: note = derived and/or modified CDS sequence (opt4) from DENV-2__GQ398260__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaagatcaccccccagagcagcatcaccgaggccgagctgatcggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcgtgaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccagaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcaacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatcggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagacacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17645 - RNA, 9876 nt, synthetic construct
  misc_feature 1..9876: note = derived and/or modified CDS sequence (opt4) from DENV-2__GQ398262__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgagactgaccatcatgaccggcgacatcaagggcatcatgcaggccggcaagagaagcctgagaccccagcccaccgagctgaagtacagctggaagacctggggcaaggccaagatgctgagcaccgagctgcacaaccagaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcaacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagacacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17646 - RNA, 9876 nt, synthetic construct
  misc_feature 1..9876: note = derived and/or modified CDS sequence (opt4) from DENV-2__GQ398261__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaactgccccctgctgagacagaacgagcccgaggacatcgactgctggtgcaacagcaccagcacctggatcacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcgtgaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccagaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcaacttctgcgagggcaccaccgtggtggtgaccggcgactgcggcaacagaggccccgccctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatcggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagacacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17647 - RNA, 9876 nt, synthetic construct
  misc_feature 1..9876: note = derived and/or modified CDS sequence (opt4) from DENV-2__GQ398313__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtggccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatgctgctggtggccgtgagcttcgtgaccctgatcaccggcaacatgagcttcagagacctgggcagagtgatggtgatggtgggcgccaccatgaccgacgacatcggcatgggcatcacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17648 - RNA, 9876 nt, synthetic construct
  misc_feature 1..9876: note = derived and/or modified CDS sequence (opt4) from DENV-2__GQ398285__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaatgggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcaccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcggcatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacctggccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctggtgaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcgccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17649 - RNA, 9876 nt, synthetic construct
  misc_feature 1..9876: note = derived and/or modified CDS sequence (opt4) from DENV-2__GQ398298__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtggccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcctgctgggcatggccctgttcctggaggagatgctgagaaccagagtgggcaccaagcacgccatgctgctggtggtggtgagcttcgtgaccctgatcaccggcaacatgagcttcagagacctgggcagagtgatggtgatggtgggcgccaccatgaccgacgacatcggcatgggcatcacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacatcaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcagaaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17650 - RNA, 9876 nt, synthetic construct
  misc_feature 1..9876: note = derived and/or modified CDS sequence (opt4) from DENV-2__GQ398301__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtggccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatgctgctggtggccgccagcttcgtgaccctgatcaccggcaacatgagcttcagagacctgggcagagtgatggtgatggtgggcgccaccatgaccgacgacatcggcatgggcatcacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17651 - RNA, 9876 nt, synthetic construct
  misc_feature 1..9876: note = derived and/or modified CDS sequence (opt4) from DENV-2__GQ398312__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtggccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatgctgctggtggccgtgagcttcgtgaccctgatcaccggcaacatgagcttcagagacctgggcagagtgatggtgatggtgggcgccaccatgaccgacgacatcggcatgggcatcacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgatcgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17652 - RNA, 9876 nt, synthetic construct
  misc_feature 1..9876: note = derived and/or modified CDS sequence (opt4) from DENV-2__GQ398289__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcgccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctgatcgccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcctgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaagaaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17653 - RNA, 9876 nt, synthetic construct
  misc_feature 1..9876: note = derived and/or modified CDS sequence (opt4) from DENV-2__GQ398290__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacttcgagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgagaactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacaccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17654 - RNA, 9876 nt, synthetic construct
  misc_feature 1..9876: note = derived and/or modified CDS sequence (opt4) from DENV-2__GQ398284__SS-prME
  source 1..9876: mol_type = other RNA
accgccggcgtgatcatcatgctgatccccaccgccatggccttccacctgaccaccagaaacggcgagccccacatgatcgtgggcaagcaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcctgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggccctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacagagccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcaaggcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcatcacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaaccacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17655 - RNA, 9876 nt, synthetic construct
  misc_feature 1..9876: note = derived and/or modified CDS sequence (opt4) from DENV-2__GQ398308__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtggccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatgctgctggtggccgtgagcttcgtgaccctgatcaccggcaacatgagcttcagagacctgggcagagtgatggtgatggtgggcgccaccatgaccgacgacatcggcatgggcatcacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacgacacccagttctgcatcaaggtgctgaacccctacatgcccagcgtgatcgagaagatggagaccctgcagagaaagtacggcggcgccatcgtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17656 - RNA, 9876 nt, synthetic construct
  misc_feature 1..9876: note = derived and/or modified CDS sequence (opt4) from DENV-2__GQ398287__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcgccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacctggccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctgatcgccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcctgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccgtgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaagaaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17657 - RNA, 9876 nt, synthetic construct
  misc_feature 1..9876: note = derived and/or modified CDS sequence (opt4) from DENV-2__GQ398302__SS-prME
  source 1..9876: mol_type = other RNA
accgccggcgtgatcatcatgctgatccccaccgccatggccttccacctgaccaccagaaacggcgagccccacatgatcgtgagcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtggccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatgctgctggtggccgtgagcttcgtgaccctgatcaccggcaacatgagcttcagagacctgggcagagtgatggtgatggtgggcgccaccatgaccgacgacatcggcatgggcatcacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17658 - RNA, 9876 nt, synthetic construct
  misc_feature 1..9876: note = derived and/or modified CDS sequence (opt4) from DENV-2__GQ398272__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcatcacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcagaggctggcccctgagcaagatggacatcggcgtgcccctgctggccatcggctgctacagccaggtgaaccccatcaccctgatcgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17659 - RNA, 9876 nt, synthetic construct
  misc_feature 1..9876: note = derived and/or modified CDS sequence (opt4) from DENV-2__GQ398292__SS-prME
  source 1..9876: mol_type = other RNA
accgccggcgtgttcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcatgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtggccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagagcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatgctgctggtggccgtgagcttcgtgaccctgatcaccggcaacatgagcttcagagacctgggcagagtgatggtgatggtgggcgccaccatgaccgacgacatcggcatgggcatcacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctgatcgacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17660 - RNA, 9876 nt, synthetic construct
  misc_feature 1..9876: note = derived and/or modified CDS sequence (opt4) from DENV-2__GQ398267__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgatcgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacatcggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgatcgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17661 - RNA, 9876 nt, synthetic construct
  misc_feature 1..9876: note = derived and/or modified CDS sequence (opt4) from DENV-2__GQ398266__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgatcgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17662 - RNA, 9876 nt, synthetic construct
  misc_feature 1..9876: note = derived and/or modified CDS sequence (opt4) from DENV-2__GQ398265__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17663 - RNA, 9876 nt, synthetic construct
  misc_feature 1..9876: note = derived and/or modified CDS sequence (opt4) from DENV-2__KX702403__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcctgatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcgagaagagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccccacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagaccgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 17664 - RNA, 9876 nt, synthetic construct
  misc_feature 1..9876: note = derived and/or modified CDS sequence (opt4) from DENV-2__KX702404__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgagatcaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcgtgggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccaacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 17665 - RNA, 9873 nt, synthetic construct
  misc_feature 1..9873: note = derived and/or modified CDS sequence (opt4) from DENV-2__JQ686088__SS-prME
  source 1..9873: mol_type = other RNA
accaccggcatgatcatcatgctgatccccaccgtgatggccttccacctgaccaccagaaacggcgagccccacatgatcgtgagcagacaggacaagggcaagagcctgctgttcaagaccaaggacggcaccaacatgtgcaccctgatggccatggacctgggcgagctgtgcgaggacaccatcacctacaagtgccccttcctgaagcagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcgccaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgacagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatgaagggcaagatcgtgcagcccgagaacctggagtacaccatcgtgatcaccccccacagcggcgaggagcacgccgtgggcaacgacaccggcaagcacggcaaggaggtgaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagacccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcaacggcatcttcgtgaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggtgggcaagagaagcctgcagccccagcccaccgagctgagatacagctggaagacctggggcaaggccaagatgctgagcaccgagctgcacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacctggccggccccgtgagccagcacaacaacagacccggctactacacccagaccgccggcccctggcacctgggcaagctggagatggacttcgacttctgcaagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcatcctgggcatggccctgttcctggaggagatgctgagaaccagagtgggcaccaagcacgccatcctgctggtggccgtgagcttcgtgaccctgatcaccggcaacatgagcttcagagacctgggcagagtgatcgtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcagcatccccgagaccatcctggagctgaccgacgccctggccctgggcatgatgatcctgaagatggtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccatcgccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtggtgagcggcctgttccccgtgagcgtgcccatcaccgccgccgcctggtacctgtgggaggtgaagaagcagagagccggcgtgctgtgggacgtgcccagccccccccccgccggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccgtgagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaagaccggcaacgacatcgccgcctgcctgagaaagaacggcaagagagtgatccagctgagcagaaagaccttcgacagcgagtacatcaagaccagaaccaacgactgggacttcgtggtgaccaccgacatcagcgagatgggcgccaacttcaaggcccagagagtgatcgaccccagaagatgcatgaagcccgtgatcctgaccgacggcgaggagagagtgatcctggccggccccatgcccgtgacccacagcagcgccgcccagagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcaccagaaacaaccagatcctggaggagaacgtggaggtggagatctggaccaaggagggcgagagaaagaagctgaagcccagatggctggacgccagaatctacgccgaccccctggccctgaaggagttcaaggagttcgccgccggcagaaagagcctgaccctgaacctgatcaccgagatgggcagactgcccaccttcatgacccagaaggtgagagacgccctggacaacctggccgtgctgcacaccgccgaggccggcggcaaggcctacaaccacgccctgaacgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgtgacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgttcctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccgtgagcaccctgtgggagggcaaccccggcagattctggaacaccaccatcgccgtgagcatggccaacatcttcagaggcagctacctggccggcgccggcctgctgttcagcatcatgaagaacaccaccagcgccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagagatgcgacaccctgctgtgcgacatcggcgagagcagccccagccccaccgtggaggccggcagaaccctgagagtgctgaacctggtggagaactggctgagcaacaacacccagttctgcgtgaaggtgctgaacccctacatgcccagcgtgatcgagaagatggaggccctgcagagaaagcacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtgggcgacggcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccatcgaggacctgaagaacgaggagatgatcaccaaccacatggagggcgagcacaagaagctggccgaggccatcttcagactgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccgccgccgaggagatcgccgtgcagaactggctggtgagagtgggcagagagagactgagcagaatggccatcagcggcgacgactgcgtggtgaagcccctggacgacagattcgccagagccctgaccgccctgaacgacatgggcaaggtgagaaaggacatccagcagtgggagcccagcagaggctggaacgactggacccaggtgcccttctgcagccaccacttccacgagctgatcatgaaggacggcagaatcctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17666 - RNA, 9876 nt, synthetic construct
  misc_feature 1..9876: note = derived and/or modified CDS sequence (opt4) from DENV-2__KF479233__SS-prME
  source 1..9876: mol_type = other RNA
accgccggcgtgatcatcatgctgatccccaccgccatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagccccagaaccagaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacaagggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccgtgctgctggtggccgtgagcttcatgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatgatcctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgagaaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggagctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagaagaagaagctgaagcccagatggctggacgccagaatctacagcgaccccctggccctgaaggagttcaaggagttcgccgccggcagaaagagcctgaccatgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgtgacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacagcctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtgatggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagatcggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatgggcgcccagctgatcagacagatggagggcgagggcgtgttcaagagcatccagcacctgaccaccaccgaggaggtggccgtgcaggactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagacacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcagcgaggagtacaccgactacatgcccagcatgaagagattcagaagagaggaggaggaggccggcgtgctgtggtga

SEQ ID NO: 17667 - RNA, 9876 nt, synthetic construct
  misc_feature 1..9876: note = derived and/or modified CDS sequence (opt4) from DENV-2__KX372564__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaaggtgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgagctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccgccctggccgtggtgagcgtgagccccctgctgctgaccagcagccagcagaagaccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcttcctgaagaacgacatccccatgaccggccccctggtggccggcggcctgctgaccgtgtgctacgtgctgaccggcagaagcgccgacctggagctggagagagccgccgacatcagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcagagccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcgtgaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaagatacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcagactgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgccaccgaggagatcgccgtgaagaactggctggtgagagtgggcagagagagactgagcagaatggccatcagcggcgacgactgcgtggtgaagcccttcgacgacagattcgccaacgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17668 - RNA, 9873 nt, synthetic construct
  misc_feature 1..9873: note = derived and/or modified CDS sequence (opt4) from DENV-2__KX274130__SS-prME
  source 1..9873: mol_type = other RNA
agcgccgccaccctgctgctgctggtgcccaccatcatggccttccacctgaccaccagaaacggcgagccccacatgatcgtggccagacacgagaagggcaagagcctgatcttcaagaccgagaacggcgtgaacatgtgcaccctgatggccatggacctgggcgagctgtgcgaggagaccgtgacctacaagtgcccctacctgaagcagagcgagcccgaggacatcgactgctggtgcaacaccaccagcacctgggtgacctacggcacctgcagcagcagcggcgagcacagaagagagaagagaagcgtggccctggccccccacgtgggcatgggcctggagaccagaaccgagacctggatgagcagcgagggcgcctggaagcacgcccagagaatcgagaactggatcctgagacaccccggctacaccgtgatggccgccgccatcgccatggccatcggcaccaacaacttccagagagccctgatcttcgtgctgctgaccgccgtggcccccagcatgaccatgagatgcgtgggcatcgccaacagagacttcgtggagggcgtgagcggcggcagctgggtggacatcgtgctggagcacggcagctgcgtgaccaccatggccaagaacaagcccaccctggacttcgagctgaccaagaccgaggccaagctgcccgccaccctgagaaagtactgcatcgaggccaagctgaccaacaccaccaccgagagcagatgccccacccagggcgagcccagcctgcccgaggagcaggacaagagattcatctgcagacacagcctggtggacagaggctggggcaacggctgcggcctgttcggcaagggcggcatcgtgacctgcgccatgttcacctgcaagaagtacatggagggcaagatcgtgcagcccgagaacctggagtacaccgtggccgtgaccccccacagcggcgaggagcacagcgtgggcaacgacaccggcaagcacggccaggacgtgaagatcaccccccagagcagcatcaccgagaccgccctggagggctacggcagcatcagcatggagtgcagccccagaaccggcctggacttcaacgagatggtgctgctgcagatggaggacaaggcctggctggtgcacagacagtggttcctggacctgcccctgccctggctgcccggcagcgacacccagggcagcaactgggtgcagaaggagaccctggtgaccttcaagaacccccacgccaagaagcaggacgtggtggtgctgggcagccaggagggcgccatgcacagcgccctgaccggcgccaccgagatccagatgaccagcggcaacctgctgttcaccggccacctgaagtgcagactgagaatggacaagctggagctgaagggcatgagctacagcatgtgcaccggcaagttcaaggtggtgaaggagatcgccgagacccagcacggcaccatcgtgatcagagtgcagtacgagggcgagggcagcccctgcaagatccccttcgagatcatggacctggagaagaagcacgtgctgggcagactgatcaccgtgaaccccatcatcaccgagaaggacaagcccaccaacatcgaggccgagccccccttcggcgacagctacatcctgatcggcgtggagcccggccagctgaagatgaactggttcaagaagggcagcagcatcggccagatgttcgagaccaccatgagaggcgccaagagaatggccatcctgggcgacaccgcctgggacttcggcagcctgggcggcgtgttcaacagcatcggcaaggccctgcaccaggtgttcggcgccgtgtacaacgccgccttcagcggcgtgagctggaccatgaagatcctgatcggcgtgatcatcacctggatcggcatgaacagcagaagcaccagcatgagcatcaccctggtgatggtgggcctggtgaccctgtacctgggcgtggtggtgcaggccgacagcggctgcgtggtgagctggaagaccaaggagctgaagtgcggcagcggcatcttcgtgaccgacaacgtgcacgtgtggaccgagcagtacaagttccagcccgagagccccgccaagctggccgccgccatcaagaaggcccacgaggagggcgtgtgcggcatcagaagcgtgaccagactggagaacatcatgtggaagcagatcacccccgagctgaaccacatcctgaccgagaacgacgtgaaggtgaccatcatgaccggcgacatcaagggcatcctgcagcagggcagaagagccctgagaccccagcccaccgagctgaagtacagctggaagagctggggcaagagcaagatcgtgagcagcgagacccacaaccagaccttcctgatcgacggccccgagaccaccgagtgccccgacaccaacagagcctggaacagcctggaggtggaggactacggcttcggcctgttcagcaccaacatctggctgagactgagagagaagcaggacaccctgtgcgacagcaagctgatgagcgccgccgtgaaggacgagagagccatccacgccgacatgggctactggatcgagagcaagctgaacggcagctggaagatcgagaaggccagcttcctggaggtgaagagctgcacctggcccagaagccacaccctgtggagcaacggcgtgctggagagcgagatgatcatccccaagaacctgggcggccccgtgagccagcacaactacagacccggctactacacccagaccaccggcccctggcacctgggcaagctggagatggacttcgactactgcgagggcaccaccgtgatcgtgaccgaggagtgcaacaacagaggccccagcctgagaaccaccaccgccagcggcaagctgatcaccgagtggtgctgcagaagctgcaccatgccccccctgagattcaagggcgaggacggctgctggtacggcatggagatcagacccctgaaggagaaggaggagaacctggtgaacagcctggtgaccgccggccacggccagatcgacaacttcagcctgggcatcctgggcatcgccctgttcctggaggaggtgatgaagagcagaatcggcatcaagcacaccatcggcatgaccatcatcaccttcctgctgctggtgaccggcaacgtgagctacagagacctgggcagagtgatcctgatggtgggcagcaccatggccgacgagatgggcatgggcgtgacctacctggccctgctggccaccttcagaatcagacccaccttcgccctggccctgatgatcagaaagctgaccagcaaggagctgctgatggccaccatcggcatcgtgctgatcgcccagtgcgacgtgcccggcaccatcctggagatcaccgacgcctgcgccctgggcctgatgctgctgaagatgaccagagagctggagagataccagctggccgtgaccctgctgagcctgacctgcatccccaacgccaccatcatgtggggcgcctggaaggtgacctgcaccatcctgaccctggtgagcatggcccccctgttcctgaccaccagcagacagaagaccgactgggtgcccgtggccctgagcatctacggcctgaaccccaccgccatctacttcaccaccctggccaaggccaagaagatcagaagctggcccctgaacgaggccgtgatggccgtgggcatggtgagcatcctggccagcagcctgctgagaaacgacatccccatggccggccccctggtggccggcggcctgctgaccctgtgctacgtgctgaccggcagaagcgccgacctggagctggagaagagcgccgacatcaagtggaacgacgacgccgagatcagcggcagcagccccatcatcaacgtggccgtgagcgaggacggcagcatgagcatcaaggacgaggaggaggagaacaccctgaccatcctgatcagaaccggcctgctggccatcagcggcatgtaccccatggccatccccgccaccgccgccgtgtggtacttctgggaggccagaaagcagagagccggcgtgctgtgggacgtgcccagccccccccccaccggcaaggccgagctggaggagggcgcctacagaatcaagcagagaggcatcttcggctacagccagatcggcgccggcgtgtacaaggagggcaccttccacaccatgtggcacgtgaccagaggcagcgtgctgatgtgcaagggcaagagactggagcccagctgggccgacgtgaagaaggacctgatcagctacggcggcggctggagactggacggcgagtggaccgagggcgaggaggtgcaggtgctggccctggagcccggcaagaaccccagagccgtgcagaccaagcccggcatgttcaagaccgacaccggcagaatcggcgccgtgagcctggacttcgcccccggcaccagcggcagccccatcatcgacaagaagggcaaggtgatcggcctgtacggcaacggcgtggtgatgaagagcggcgcctacgtgagcagcatcgcccagaccgagaagagagaggacgagatccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcgccaccagagtggagatgggcgaggccgccggcatcttcatgaccgccaccccccccggcagcaaggaccccttcccccagagcaacgcccccatcatggacgaggagagagagatccccgagagaagctggaacagcggccacgagtggatcaccgacttcgagggcaagaccgtgtggttcgtgcccagcatcagagccggcaacgacatcgccacctgcctgagaaagaacggcaagaaggtgatccagctgagcagaaagaccttcgacaccgagtacatcaagaccagaaacaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccccagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccgccatgttcggccccgagagagagaagaccgacgccatcgacggcgagtacagactgagaggcgagagcagaaagaccttcgtggagctgatgagaagaggcgacctgcccgtgtggctggcctacaaggtggccagcgagggctacagctacgccgacagaagatggtgcttcgagggcgtgaagaacaaccagatcctggaggagaacctggaggtggagatctggaccaaggagggcgagagaaagaagctgagacccaagtggctggacgccagaacctacagcgacccccaggccctgaaggacttcaaggagttcgccgccggcagaaagagcaccaccctgaacctgatcgccgagctgggcagactgcccacctacatgacccagaagaccagagacgccctggacaacctggccgtgctgcacaccgccgaggagggcggcagagcctaccagcacgccatcagcgagctgcccgagaccctggagaccctgctgctgctgtgcctgctggccaccgtgagcggcggcgtgttcctgttcctgatgagcggcaagggcatcggcaagatgagcatgggcctgggctgcatcatcaccgccagcggcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccctggtggccgccaccatggccaacgagatgggctacctggagaagaccaagaaggacctgggcttcggcaacccctacgtggccagccacgaggccgccatcctggacatcgacctgcaccccgccagcgcctggaccctgtacgccgtggccaccaccctgatcacccccatgctgagacacagcatcgagaacagcagcaccaacgtgagcctgaccgccatcgccaaccaggccaccgtgctgatgggcctgggcaagggctggcccctgagcagaatggacctgggcgtgcccctgctggccctgggctgctacagccaggtgaaccccctgaccctgaccgccagcctgctgctgctgatcggccactacgccatcatcggccccggcctgcaggccaaggccaccagagaggcccagaagagaaccgccgccggcatcatgaagaaccccaccgtggacggcatcaccgtgatcgacatcgagcccatcccctacgaccccaagttcgagaagcagctgggccaggtgatgctgctggtgctgtgcgtggcccaggtgctgatgatgagaaccacctgggccatgtgcgaggccctgaccatcgccaccggccccatcagcaccctgtgggagggcaaccccggcaagttctggaacaccaccatcgccgtgagcatggccaacatcttcagaggcagctacctggccggcgccggcctgctgttcagcatcatgaagaacaccgtgaccggcagaagaggcaccggcgtggccggcgagaccctgggcgagaagtggaagatcaagctgaacggcctgggcagaaccgacttccagacctacaagagaagcggcatcatcgaggtggacagaaccctggccaaggagggcatcaagagaggcgagaccaaccaccacgccgtgagcagaggcagcgccaagctgagatggttcgtggagagaaacctggtgaagcccgagggcaaggtgatcgacctgggctgcggcagaggcggctggagctactactgcggcggcctgaagaacgtgaccgaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacatggtggagaactggctgggcaacaaccagttctgcatcaaggtgctgaacccctacatgcccagcgtgatcgagaagatggagaacctgcagagaaagttcggcggcaccctggtgagaaaccccctgagcagaaacagcacccacgagatgtactgggtgagcaacgccagcggcaacatcgtgagcagcgtgaacatgatcagcagaatgctgatcaacagattcaccatgaagcacaagaagcccacctacgagcaggacgtggacctgggcagcggcaccagaaacgtgggcatcgagaccgagaagcccaacctggagatcatcggcaagagaatcgagaagatcaaggacgagcacaagcagacctggcactacgacctggaccacccctacaagacctgggcctaccacggcagctacgagaccaagcagaccggcagcgccagcagcatgatcaacggcgtggtgaagctgctgaccaagccctgggacgtgatccccatggtgacccagatggccatgaccgacaccacccccttcggccagcagagagtgttcaaggagaaggtggacaccagaacccccgagcccaaggagggcaccaagaagctgatgaagctgaccgccaagtggctgtgggccgagctgggcagacacaaggtgcccagaatgtgcaccagagacgagttcaccaacaaggtgagaagcaacgccgccatgggcgccgtgttcaccgaggagaacagatggagcagcgccaaggaggccgtggaggacgaggccttctgggacctggtggacagagagagaaagctgcacctgcagggcaagtgcgagacctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagagatcggcgccaaggacggcggcatgatgtacgccgacgacaccgccggctgggacaccagagtgaccgaggaggacctgaagaacgaggagatgatcagcgagcagatgaagggcgagcacagaaccctggccgaggccatcttcaagctgacctaccagaacaaggtggtgagagtgcagagacccacccccaagggcaccgtgatggacatcatcagcagaagagaccagagaggcagcggccaggtgggcacctacggcctgaacaccttcaccaacatggaggcccagctgatcagacagatggagggcgagggcctgttcagagacatcagcaagctgaccatccaggaggagaccgccatcctgacctggctgaaggagaagggcagagacagactgagcagaatggccatcagcggcgacgactgcgtggtgaagcccgtggacgacagattcgcccacgccctgaccgccctgaacgacatgggcaaggtgagaaaggacatccagcagtgggaggccagcaagggctggaacgactggacccaggtgcccttctgcagccaccacttccacgagatcatcatgaaggacggcagaaagctggtggtgccctgcagaaaccaggacgagctgatcggcagagccagaatcagccagggcgccggctgggccctgaaggagaccgcctgcctgggcaaggcctacgcccagatgtggagcctgatgtacttccacagaagagacctgagactggccgccaacgccatctgcagcgccgtgcccagccactgggtgcccaccagcagaaccacctggagcatccacgcccaccaccagtggatgaccaccgaggacatgctggacgtgtggaacagagtgtggatcctggagaacccctggatggacgacaagacctgcgtgaagagctgggaggaggtgccctacctgggcaagagagaggaccagtggtgcggcagcctgatcggcctgaccagcagagccacctgggccaagaacatcaaggtggccatcgagcaggtgagaagcctgatcggcaaggaggagtacaccgactacatgcccagcatgaagagattcaagcaggagcagagcaccgagggcgccctgtggtga

SEQ ID NO: 17669 - RNA, 9876 nt, synthetic construct
  misc_feature 1..9876: note = derived and/or modified CDS sequence (opt4) from DENV-2__GU289914__SS-prME
  source 1..9876: mol_type = other RNA
agcgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggaccccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatggtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcagaaccaacgccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaagatcagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17670 - RNA, 9876 nt, synthetic construct
  misc_feature 1..9876: note = derived and/or modified CDS sequence (opt4) from DENV-2__AY858036__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcgtgaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctggccagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgagaccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcgagttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcagactgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17671 - RNA, 9876 nt, synthetic construct
  misc_feature 1..9876: note = derived and/or modified CDS sequence (opt4) from DENV-2__HQ332184__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagaatccagtacgagggcgacggcagcccctgcaagatccccttcgagatcaccgacctggagaagagacacgtgctgggcagactgatcaccgtgaaccccatcgtgatcgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccggctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccaccctgctggtggccgccagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgagaaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17672 - RNA, 9876 nt, synthetic construct
  misc_feature 1..9876: note = derived and/or modified CDS sequence (opt4) from DENV-2__HQ332185__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagaatccagtacgagggcgacggcagcccctgcaagatccccttcgagatcaccgacctggagaagagacacgtgctgggcagactgatcaccgtgaaccccatcgtgatcgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagatcaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaagaacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgagaaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17673 - RNA, 9876 nt, synthetic construct
  misc_feature 1..9876: note = derived and/or modified CDS sequence (opt4) from DENV-2__HQ332186__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgatcgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccttctggagcaacggcgtgctggagagcgagatgatcatccccaagaacttcgccggccccgtgagccagcacaactacagacccggctaccacacccagatcgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgagaaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacacctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17674 - RNA, 9876 nt, synthetic construct
  misc_feature 1..9876: note = derived and/or modified CDS sequence (opt4) from DENV-2__HQ332187__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagaatccagtacgagggcgacggcagcccctgcaagatccccttcgagatcaccgacctggagaagagacacgtgctgggcagactgatcaccgtgaaccccatcgtgatcgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatgatcctgaagatcgtgagaaacatggagaagtaccagctggccgtgaccatcatggccatcagctgcgtgcccaacgccgtgatcctgagaaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgtgatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattcggcgagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17675 - RNA, 9876 nt, synthetic construct
  misc_feature 1..9876: note = derived and/or modified CDS sequence (opt4) from DENV-2__HQ332188__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgatcgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcgtgatgcaggccggcaagagaagcctgagaccccagcccaccgagctgaagtacagctggaagacctggggcaaggccaagatgctgagcaccgagagccacaaccagaccttcctgatcgacggccccgagaccaccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagatcgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgccacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgagaaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggagatccaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17676 - RNA, 9876 nt, synthetic construct
  misc_feature 1..9876: note = derived and/or modified CDS sequence (opt4) from DENV-2__HQ332189__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagaactggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgatcgagaaggacagccccgtgaacatcgaggccgagccccccttcggcgacagctacgtgatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgagaaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccagccccaccatcgaggccggcagaaccctgagagtgctgaacctggtggaggactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacacctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17677 - RNA, 9876 nt, synthetic construct
  misc_feature 1..9876: note = derived and/or modified CDS sequence (opt4) from DENV-2__JN368476__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagagcaaggcctggctggtgcacagacagtggttcctggacctgcccctgccctggctgcccggcgccgacaagcagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagaccgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcaccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagagacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacaccggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagacctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaaggaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggccgccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17678 - RNA, 9876 nt, synthetic construct
  misc_feature 1..9876: note = derived and/or modified CDS sequence (opt4) from DENV-2__JF260983__SS-prME
  source 1..9876: mol_type = other RNA
accgccggcttcctgatcatggtgatccccaccgtgatggccttccacctgaccaccagaaacggcgagccccacatgatcgtgagcaagaacgagaagggcaagggcctgctgttcaagaccgagaacggcatcaacatgtgcaccctgatggccatggacctgggcgagctgtgcgaggacaccgtgacctacaagtgccccttcctgaagcagaacgagcccgaggacatcgactgctggtgcaacagcaccagcacctgggtgacctacggcacctgcagcagcaccggcgagcacagaagagagaagagaagcgtggccctggtgccccacgtgggcatgggcctggagaccagaaccgagacctggatgagcagcgagggcgcctggaagcaggcccagagaatcgagacctggatcctgagacaccccggcttcaccctgatggccgccgtgctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagttctgcatcgaggccaagctgaccaacaccaccaccgagagcagatgccccacccagggcgagcccagcctggtggaggagcaggacaagagattcgtgtgcagacacagcatggtggacagaggctggggcaacggctgcggcctgttcggcaagggcggcatcgtgacctgcgccatgttcacctgcctgaagaagatggagggcaaggtggtgcagcccgagaacctggagtacaccatcgtgatcaccccccacagcggcgaggagcacgccgtgggcaacgacaccggcaagcacggcaaggaggtgaagatcaccccccagagcagcatcagcgagaccgagctgaccgactacggcaccatcaccatggagtgcagccccagaaccggcctggacttcaacgagatggtgctgctgcagatggagagcaaggcctggctggtgcacagacagtggttcctggacctgcccctgccctggctgcccggcgccgacacccagggcagcaactggatccagaaggagatgctggtgaccttcaagaacccccacgccaagagacaggacgtggtggtgctgggcagccaggagggcgccatgcacaccgccctgaccggcgccaccgagatccagatgagcctgggcaacatcctgttcatgggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacgacagcccctgcaagatccccttcgagatcatggacctggagaagaagcacgtgctgggcagactgatcaccgtgaaccccatcgtgaccgagaaggacagccccatcaacatcgaggccgagccccccttcggcgacagctacatcgtgatcggcgtggagcccggccagctgaagctgaactggttcaagaagggcagcagcatcggccagatgttcgagaccaccatgagaggcgccaagagaatggccatcctgggcgacaccgcctgggacttcggcagcatcggcggcgtgttcaccagcgtgggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgaccctggtgctggtgggcatcgtgaccctgtacctgggcgtgatggtgcaggccgacagcggctgcgtggtgagctggaagaacaaggagctgaagtgcggcagcggcatcttcgtgaccgacaacgtgcacacctggaccgagcagtacaagttccagcccgacagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgagatcaagggcatcatgcaggccggcagaagaagcctgaagccccagcccaccgagctgagatacagctggaagacctggggcaaggccaaggtgctgagcaccgagctgcagaaccagaccttcctgatcgacggccccgagaccaccgagtgccccaacagcaacagagcctggaacagcctggaggtggaggactacggcttcggcatcttcaccaccaacatctggctgaagctgagagagaagcaggacatgatctgcgacagcaagctgatgagcgccgccgtgaaggacgacagagccgtgcacgccgacatgggctactggatcgagagcagactgaacgacacctggaagatggagaaggccagcttcatcgaggtgaagagctgctactggcccagaagccacaccctgtggagcaacggcgtgctggagagcgagatgatcatccccaagaacctggccggccccgtgagccagcacaactacagacccggctactacacccagaccgccggcccctggcacctgggcaagctggagatggacttcgagttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagagagaggagaacctggtgaacagcctggtgaccgccggccacggccagatcgacaacttcagcctgggcatcctgggcatggccctgctgctggaggagatgctgagaaccagagtgggcaccaagcacgccctgctgctggtggccatcagcttcgtgaccctgatcaccggcaacatgagcttcaaggacctgggcagagtgatcatcatggtgggcgccgccatgaccgacgagatgggcatgggcgtgacctacctggccctgctggccgccttcagagtgagacccaccttcgccgtgggcctgctgctgagaaagctgaccagcaaggagctgctgatggccaccatcggcgtggtgctgctgagccagagcaacatccccggcaccgtgctggagctgaccgacgccatcgccctgggcatcatggtgctgaagatcatgagaagcatggagaagtaccagctggccgtgaccgtgatggccatgctgtgcatccccaacgtgatgatcctgcagcacgcctggaaggtgggctgcaccatcctggccgccgtgagcgtgagccccctgctgctgaccagcagccagcagaagaccgactggatccccctggccctgaccatcaagggcctgaaccccaccgccatcttcctgaccaccctgagcagacccagcaagatcagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagaaggccgccgaggtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggagaccaagaagcagagagccggcgtgctgtgggacgtgcccagccccccccccatgggcaaggccgagctggaggacggcgcctacagaatcaagcagagaggcatcttcggctacagccagatcggcgccggcgtgtacaaggagggcaccttccacaccatgtggcacgtgaccagaggcgccgtgctggtgcacaagggcaagagactggagcccagctgggccgacgtgaagaaggacctgatcagctacggcggcggctggaagctggagggcgagtggaaggacggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacagaaagggcaaggtggtgggcctgtacggcaacggcgtggtgaccagaagcggcacctacgtgagcagcatcgcccagaccgagaagagcgtggaggacaaccccgagatcgaggacgacatcttcagaaagaagagactgaccatcatggacctgcaccccggcgccggcaagaccaagagatacctgcccgccatcgtgagagaggccatcagaagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtggatcaccaacttcaagggcaagaccgtgtggttcgtgcccagcatcagagccggcaacgacatcgccgcctgcctgagaaagaacggcaagagagtgatccagctgagcagaaagaccttcgacaccgagtacaccaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtggtgctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgaagagaggcgacctgcccgtgtggctggcctacaaggtggccagcgagggcatcaactacgccgacagaaagtggtgcttcgacggcatcagaaacaaccagatcctggaggagaacatcgaggtggaggtgtggaccaaggagggcgagagaaagaagctgaagcccagatggctggacgccagaacctacagcgaccccctggccctgaaggagttcaaggagttcgccgccggcagaaagagcctgaccctgagcctgatcaccgagatgggcagactgcccaccttcatgacccagaagaccagagacgccctggacaacctggccgtgctgcacagcgccgagatgggcggcagagcctacaaccacgccctgagcgagctgcccgagaccctggagaccctgctgctgctgggcctgctggccaccgtgaccggcggcatcttcctgttcctgatgagcggcagaggcgtgggcaagatgaccctgggcatgtgctgcatcatcaccgccagcggcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccctggtggccgccaccatggccaacgagatgggcttcctggagaagaccaagaaggacctgggcctgggcggcttcaccatgcagcagcccgagatcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcaagttctggaacaccaccatcgccgtgagcatggccaacatcttcagaggcagctacctggccggcgccggcctgctgttcagcatcatgagaaacaccaccagcgccagaagaggcaccggcaccatcggcgagaccctgggcgagaagtggaagagcagactgaacgccctgggcagaagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtggcccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagagatgcgacaccctgctgtgcgacatcggcgagagcagccccaaccccaccgtggaggccggcagaaccctgagagtgctgaacctggtggagaactggctgggcagcaacacccagttctgcatcaaggtgctgaacccctacatgcccagcgtgatcgagagaatggagaccctgcagagaaagttcggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagtgcgagacccccaacatggacatcatcggcaagagaatcgagaagatcaagcaggagcacgaggccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgagaatcaccgccgagtggctgtggggcgagctgggcagaagaaagaagcccagaatctgcaccagagccgagttctgcaacaaggtgagaagcaacgccgccctgggcgccgtgttcaccgacgagaacaagtggaagagcgccagagaggccgtggaggacgagagattctgggagctggtggagaaggagagaaacctgcacctggacggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacatcagcagaaaggccggcggcgccatgtacgccgacgacaccgccggctgggacaccagaatcaccagcgaggacctgaagaacgaggagatgatcaccgaccagatggagggcagacacaagaagctggccgaggccatcttcagactgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcctgttcaagagcatcctgcacctgaccccccaggaggagaccgccgtgcacgcctggctggtgagagagggcagagagagactggccagaatggccatcagcggcgacgactgcgtggtgaagcccctggacgacagattcgccagagccctgaccgccctgaacgacatgggcaaggtgagaaaggacatccagcagtgggagcccagcaagggctggagcgactggacccaggtgcccttctgcagccaccacttccacgagctgatcatgaaggacggcagaaagctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagccacgagtggatgaccaccgaggacatgctggccgtgtggaacagagtgtggatccaggacaacccctggatggaggacaagacccccgtggagagctgggaggacatcccctacctgggcaagagagaggaccagtggtgcggcagcctgatcggcctgaccagcagagccacctgggccaagaacatccagaccgccatcaaccaggtgagagccctgatcggcgaggaggagtacatggactacatgcccagcatgaagagattcagaagcgaggaggaggagagcggcgtgctgtggtga

SEQ ID NO: 17679 - RNA, 9876 nt, synthetic construct
  misc_feature 1..9876: note = derived and/or modified CDS sequence (opt4) from DENV-2__AF119661__SS-prME
  source 1..9876: mol_type = other RNA
accgtgggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcatcatcatggccgccatcctggcctacaccatcggcaccacccacttccagagagccctgatcttcatcctgctgaccgccgtggcccccagcatgaccatgagatgcatcggcgtgagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgtgaccctgagaaagtactgcatcaaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccaccttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactgggtgaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagagcctggtggacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcctgagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctggccagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagaagggcatcctgggctacagccagatcggcaccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccaacatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatggtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcttcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacaacagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggccgtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17680 - RNA, 9876 nt, synthetic construct
  misc_feature 1..9876: note = derived and/or modified CDS sequence (opt4) from DENV-2__EU056810__SS-prME
  source 1..9876: mol_type = other RNA
accgccggcatcatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcgtgaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagctgcacaaccagaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggaggtggacttcaacttctgcgagggcaccaccgtggtggtgaccggcgactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccgtgaccgaggagatcaccgtgaagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagacacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17681 - RNA, 9876 nt, synthetic construct
  misc_feature 1..9876: note = derived and/or modified CDS sequence (opt4) from DENV-2__EU056811__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccaaggacggcaccaacatgtgcaccctgatggccatggacctgggcgagctgtgcgaggacaccatcacctacaagtgccccttcctgaagcagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccatcgcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgacagcagatgccccacccagggcgagcccaccctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccgtggtgatcaccccccacagcggcgaggagcacgccgtgggcaacgacaccggcaagcacggcaaggaggtgaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctggactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcgtgaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcaccagcgagctgaaccacatcctgagcgagaacgaggtgaagctgaccatcatgaccggcgacatcaagggcatcatgcaggtgggcaagagaagcctgagaccccagcccaccgagctgagatacagctggaagacctggggcaaggccaagatgctgagcaccgagctgcacaaccagaccttcctgatcgacggccccgagaccgccgagtgccccaacaccaacagagcctggaacagcctggaggtggaggactacggcttcggcgtgttcaccaccaacatctggctgagactgagagagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatggtgatccccaagaacatcgccggccccgtgagccagcacaacaacagacccggctaccacacccagaccgccggcccctggcacctgggcaagctggagatggacttcgacttctgcgagggcaccaccgtggtggtgaccgaggagtgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgagcagcctggtgaccgccggccacggccagatcgacaacttcagcctgggcatcctgggcatggccctgttcctggaggagatgctgagaaccagagtgggcaccaagcacgccatcctgctggtggccgtgagcttcctgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcagcatccccgagaccatcctggagctgaccgacgccctggccctgggcatgatggtgctgaagatggtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgaccagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggacgaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcagagccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcagaaccaacaccggcaccatcggcgccgtgagcctggacttcagccccggcaccagcggcagccccatcgtggacaagaagggcaaggtggtgggcctgtacggcaacggcgtggtgaccagaggcggcgcctacgtgagcgccatcgcccagaccgagaagggcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaagaccggcaacgacatcgccgcctgcctgagaaagaacggcaagagagtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccagaaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcaccagaaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcaaggcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtgatcatcgccatcctgaccgtggtggccgccaccatggccaacgagatgggcttcctggagaagaccaagaaggacctgggcctgggccacatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgatgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccgtgagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatgggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcgtgccccccgagaagtgcgacaccctgctgtgcgacatcggcgagagcagccccaaccccaccgtggaggccggcagaaccctgagagtgctgaacctggtggagaactggctgaacaacaacacccagttctgcgtgaaggtgctgaacccctacatgcccagcgtgatcgagagaatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacaacagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccatcgaggacctgaagaacgaggagatgatcaccaaccacatggccggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgccagcgaggagatcgccgtgcaggactggctggtgagagtgggcagagagagactgagcagaatggccatcagcggcgacgactgcgtggtgaagcccctggacgacagattcgccaaggccctgaccgccctgaacgacatgggcaaggtgagaaaggacatccagcagtgggagcccagcagaggctggaacgactggacccaggtgcccttctgcagccaccacttccacgagctgatcatgaaggacggcagaaccctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagccacgagtggatgaccaccgaggacatgctgaccgtgtggaacagagtgtggatcctggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17682 - RNA, 9876 nt, synthetic construct
  misc_feature 1..9876: note = derived and/or modified CDS sequence (opt4) from DENV-2__DQ645545__SS-prME
  source 1..9876: mol_type = other RNA
accgccggcgtgatcatcatgatgatccccaccgtggtggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagccagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccggcaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcggcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtgatggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgccaccgaggagatcgccgtgaagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatcgaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17683 - RNA, 9876 nt, synthetic construct
  misc_feature 1..9876: note = derived and/or modified CDS sequence (opt4) from DENV-2__DQ645546__SS-prME
  source 1..9876: mol_type = other RNA
accgccggcgtgatcatcatgatgatccccaccgtggtggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcggcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtgatggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgccaccgaggagatcgccgtgaagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatcgaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17684 - RNA, 9876 nt, synthetic construct
  misc_feature 1..9876: note = derived and/or modified CDS sequence (opt4) from DENV-2__DQ645547__SS-prME
  source 1..9876: mol_type = other RNA
accgccggcgtgatcatcatgatgatccccaccgtggtggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagtacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcggcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtgatggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgccaccgaggagatcgccgtgaagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatcgaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17685 - RNA, 9876 nt, synthetic construct
  misc_feature 1..9876: note = derived and/or modified CDS sequence (opt4) from DENV-2__DQ645549__SS-prME
  source 1..9876: mol_type = other RNA
accgccggcgtgatcatcatgatgatccccaccgtggtggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcggcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtgatggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggtgaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgccaccgaggagatcgccgtgaagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatcgaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17686 - RNA, 9876 nt, synthetic construct
  misc_feature 1..9876: note = derived and/or modified CDS sequence (opt4) from DENV-2__DQ645550__SS-prME
  source 1..9876: mol_type = other RNA
accgccggcgtgatcatcatgatgatccccaccgtggtggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcggcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagactgtggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtgatggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggtgaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgccaccgaggagatcgccgtgaagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatcgaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17687 - RNA, 9876 nt, synthetic construct
  misc_feature 1..9876: note = derived and/or modified CDS sequence (opt4) from DENV-2__DQ645551__SS-prME
  source 1..9876: mol_type = other RNA
accgccggcgtgatcatcatgatgatccccaccgtggtggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacaccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcggcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtgatggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgccaccgaggagatcgccgtgaagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatcgaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17688 - RNA, 9876 nt, synthetic construct
  misc_feature 1..9876: note = derived and/or modified CDS sequence (opt4) from DENV-2__DQ645552__SS-prME
  source 1..9876: mol_type = other RNA
accgccggcgtgatcatcatgatgatccccaccgtggtggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcggcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtgatggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccaccagcagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgccaccgaggagatcgccgtgaagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatcgaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17689 - RNA, 9876 nt, synthetic construct
  misc_feature 1..9876: note = derived and/or modified CDS sequence (opt4) from DENV-2__DQ645553__SS-prME
  source 1..9876: mol_type = other RNA
accgccggcgtgatcatcatgatgatccccaccgtggtggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagccccggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcggcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtgatggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgccaccgaggagatcgccgtgaagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctggccgtgtggaacagagtgtggatccaggagaacccctggatcgaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17690 - RNA, 9876 nt, synthetic construct
  misc_feature 1..9876: note = derived and/or modified CDS sequence (opt4) from DENV-2__DQ645554__SS-prME
  source 1..9876: mol_type = other RNA
accgccggcgtgatcatcatgatgatccccaccgtggtggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcggcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtgatggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgccaccgaggagatcgccgtgaagaactggctggccagagtgggcagagagagactgagcagaatggccatcagcggcgacgactgcgtggtgaagcccctggacgacagattcgccagcgccctgaccgccctgaacgacatgggcaagatcagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatcgaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17691 - RNA, 9876 nt, synthetic construct
  misc_feature 1..9876: note = derived and/or modified CDS sequence (opt4) from DENV-2__DQ645555__SS-prME
  source 1..9876: mol_type = other RNA
accgccggcgtgatcatcatgatgatccccaccgtggtggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagccagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcggcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtgatggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgccaccgaggagatcgccgtgaagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatcgaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17692 - RNA, 9876 nt, synthetic construct
  misc_feature 1..9876: note = derived and/or modified CDS sequence (opt4) from DENV-2__DQ645556__SS-prME
  source 1..9876: mol_type = other RNA
accgccggcgtgatcatcatgatgatccccaccgtggtggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcggcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtgatggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagaacatccagcagctgaccgccaccgaggagatcgccgtgaagaactggctggccagagtgggcagagagagactgagcagaatggccatcagcggcgacgactgcgtggtgaagcccctggacgacagattcgccagcgccctgaccgccctgaacgacatgggcaaggtgagaaaggacgtgcagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatcgaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17693 - RNA, 9876 nt, synthetic construct
  misc_feature 1..9876: note = derived and/or modified CDS sequence (opt4) from DENV-2__AF204178__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccggcgacggcgtgaacatgtgcaccctgatggccatggaccccggcgagctgtgcgaggacaccatcacctacaagtgccccctgctgaagcagaacgagcccgaggacatcgactggtggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatgatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgacagcagatgccccacccagggcgagcccagcctgaacgaggagcaggacaagagattcgtgtgcaagcacagcatggtggacagaggctggggcaacggctgcggcctgttcggcaagggcggcatcgtgaccttcgccatgttcacctgcaagaagaacatgaagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatgaagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacgacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgtgatcaaggacaacagagccgcccacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatggtgagaaagatggagaagtaccagctggccgtgaccatcatggccatcctgtgcgtgcccaacgccgtgatcctgcagaacgcctggaaggtgagctgcaccatcctggccgtggtgagcgtgagccccctgttcatcaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagatcctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacgccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaaagctgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggagcagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccaagatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgttcctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagatcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgggcaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgtacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccgtgaccgaggagatcgccgtgcagaactggctggccagagtgagaagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17694 - RNA, 9876 nt, synthetic construct
  misc_feature 1..9876: note = derived and/or modified CDS sequence (opt4) from DENV-2__AF204177__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccggcgacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacctggagctgatcaagaccgaggccaagcagagcgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatgaagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacgaggtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtgctgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatggtgagaaagatggagaagtaccagctggccgtgaccatcatggccatcctgtgcgtgcccaacgccgtgatcctgcagaacgcctggaaggtgagctgcaccatcctggccgtggtgagcgtgagccccctgttcctgaccagcagccagcagaaggccgactggatccccctggccctgaccatcaagggcctgaaccccaccgccatcttcctgaccaccctgagcaagaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagatcctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacgccggcggctggaagctggagggcgagtggaaggagggcgaggaggtgcaggtgctggccctggagcccggcaagaaccccagagccgtgcagaccaagcccggcctgttcaagaccaacgccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaaagctgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggagcagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgttcctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagagaggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccctgtggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagagaaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccagaacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagaccagcgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17695 - RNA, 9876 nt, synthetic construct
  misc_feature 1..9876: note = derived and/or modified CDS sequence (opt4) from DENV-2__DQ645540__SS-prME
  source 1..9876: mol_type = other RNA
accgccggcgtgatcatcatgatgatccccaccgtggtggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgaccaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcggcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtgatggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggtgaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgccaccgaggagatcgccgtgaagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatcgaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17696 - RNA, 9876 nt, synthetic construct
  misc_feature 1..9876: note = derived and/or modified CDS sequence (opt4) from DENV-2__DQ645541__SS-prME
  source 1..9876: mol_type = other RNA
accgccggcgtgatcatcatgatgatccccaccgtggtggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgaccaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcggcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtgatggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgccaccgaggagatcgccgtgaagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatcgaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17697 - RNA, 9876 nt, synthetic construct
  misc_feature 1..9876: note = derived and/or modified CDS sequence (opt4) from DENV-2__DQ645542__SS-prME
  source 1..9876: mol_type = other RNA
accgccggcgtgatcatcatgatgatccccaccgtggtggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgaccaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcggcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtgatggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgccaccgaggagatcgccgtgaagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatcgaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17698 - RNA, 9876 nt, synthetic construct
  misc_feature 1..9876: note = derived and/or modified CDS sequence (opt4) from DENV-2__AY702036__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatgcccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaacagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcagcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17699 - RNA, 9876 nt, synthetic construct
  misc_feature 1..9876: note = derived and/or modified CDS sequence (opt4) from DENV-2__AY702034__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatgcccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaacagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcagcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17700 - RNA, 9876 nt, synthetic construct
  misc_feature 1..9876: note = derived and/or modified CDS sequence (opt4) from DENV-2__AF208496__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccttcctgagacagaacgagcccgaggacatcgactgctggtgcaacttcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatgcccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcagcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacaagagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17701 - RNA, 9876 nt, synthetic construct
  misc_feature 1..9876: note = derived and/or modified CDS sequence (opt4) from DENV-2__AY702040__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccaaggacggcaccaacatgtgcaccctgatggccatggacctgggcgagctgtgcgaggacaccatcacctacaagtgccccttcctgaagcagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccatcgcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgacagcagatgccccacccagggcgagcccaccctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccgtggtgatcaccccccacagcggcgaggagcacgccgtgggcaacgacaccggcaagcacggcaaggaggtgaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctggactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcgtgaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcaccagcgagctgaaccacatcctgagcgagaacgaggtgaagctgaccatcatgaccggcgacatcaagggcatcatgcaggtgggcaagagaagcctgagaccccagcccaccgagctgagatacagctggaagacctggggcaaggccaagatgctgagcaccgagctgcacaaccagaccttcctgatcgacggccccgagaccgccgagtgccccaacaccaacagagcctggaacagcctggaggtggaggactacggcttcggcgtgttcaccaccaacatctggctgagactgagagagaagcaggacgccttctgcgaccccaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatggtgatccccaagaacttcgccggccccgtgagccagcacaacaacagacccggctaccacacccagaccgccggcccctggcacctgggcaagctggagatggacttcgacttctgcgagggcaccaccgtggtggtgaccgaggagtgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgagcagcctggtgaccgccggccacggccagatcgacaacttcagcctgggcatcctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcagcatccccgagaccatcctggagctgaccgacgccctggccctgggcatgatggtgctgaagatggtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggacgaccaggccgagatcagcggcagcagccccatcctgagcatcatcatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcagagccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcagaaccaacaccggcaccatcggcgccgtgagcctggacttcagccccggcaccagcggcagccccatcgtggacaagaagggcaaggtggtgggcctgtacggcaacggcgtggtgaccagaggcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaagaccggcaacgacatcgccgcctgcctgagaaagaacggcaagagagtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccagaaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcaccagaaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcaaggcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtgatcatcgccatcctgaccgtggtggccgccaccatggccaacgagatgggcttcctggagaagaccaagaaggacttcggcctgggccacatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccgtgagcaccctgtgggagggcaaccccggcagattctggaacaccaccatcgccgtgagcatggccaacatcttcagaggcagctacctggccggcgccggcctgctgttcagcatcatgaagaacaccaccagcgccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcgtgccccccgagaagtgcgacaccctgctgtgcgacatcggcgagagcagccccaaccccaccgtggaggccggcagaaccctgagagtgctgaacctggtggagaactggctgaacaacaacacccagttctgcgtgaaggtgctgaacccctacatgcccagcgtgatcgagagaatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacaacagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccatcgaggacctgaagaacgaggagatgatcaccaaccacatggccggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccagcgaggagatcgccgtgcaggactggctggtgagagtgggcagagagagactgagcagaatggccatcagcggcgacgactgcgtggtgaagcccctggacgacagattcgccaaggccctgaccgccctgaacgacatgggcaaggtgagaaaggacatccagcagtgggagcccagcagaggctggaacgactggacccaggtgcccttctgcagccaccacttccacgagctgatcatgaaggacggcagaaccctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagccacgagtggatgaccaccgaggacatgctgaccgtgtggaacagagtgtggatcctggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17702 - RNA, 9876 nt, synthetic construct
  misc_feature 1..9876: note = derived and/or modified CDS sequence (opt4) from DENV-2__AY037116__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgcggctgccacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtgacccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctggtgaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgcctgggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgccagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacatcatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17703 - RNA, 9876 nt, synthetic construct
  misc_feature 1..9876: note = derived and/or modified CDS sequence (opt4) from DENV-2__AF169678__SS-prME
  source 1..9876: mol_type = other RNA
agcgccggcatgatcatcatgctgatccccaccgtgatggccttccacctgaccaccagaaacggcgagccccacatgatcgtgagcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgatcctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatccagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatgatcacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgaagcacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgccaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17704 - RNA, 9876 nt, synthetic construct
  misc_feature 1..9876: note = derived and/or modified CDS sequence (opt4) from DENV-2__AF169679__SS-prME
  source 1..9876: mol_type = other RNA
agcgccggcatgatcatcatgctgatccccaccgtgatggccttccacctgaccaccagaaacggcgagccccacatgatcgtgagcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccaagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgatcctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcagaaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatgatcacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgaagcacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgccaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17705 - RNA, 9876 nt, synthetic construct
  misc_feature 1..9876: note = derived and/or modified CDS sequence (opt4) from DENV-2__AF169680__SS-prME
  source 1..9876: mol_type = other RNA
agcgccggcatgatcatcatgctgatccccaccgtgatggccttccacctgaccaccagaaacggcgagccccacatgatcgtgagcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcatcatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaacttcctgatcgacggccccgagaccgccgagtgccccaacaccaacagagcctggaacagcctggaggtggaggactacggcttcggcgtgttcaccaccaacgtgtggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgatcctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggagagacaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaaagatgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcagaaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccagcgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacaccgtgagcagaggcagcgccaagctgagatggttcgtggagagaaacatgatcacccccgagggcaaggtgctggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgaagcacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgccaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17706 - RNA, 9876 nt, synthetic construct
  misc_feature 1..9876: note = derived and/or modified CDS sequence (opt4) from DENV-2__AF169682__SS-prME
  source 1..9876: mol_type = other RNA
agcgccggcatgatcatcatgctgatccccaccgtgatggccttccacctgaccaccagaaacggcgagccccacatgatcgtgagcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcagaatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgatcctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccagcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctggccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggtgttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgaagcacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgccaccgaggagatcgccgtgcagaactgcctggccagactgggcagagagagactgagcagaatggccatcagcggcgacgactgcgtggtgaagcccctggacgacagattcgccagcgccctgaccgccctgaacgacatgggcaagatcagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17707 - RNA, 9876 nt, synthetic construct
  misc_feature 1..9876: note = derived and/or modified CDS sequence (opt4) from DENV-2__AF169681__SS-prME
  source 1..9876: mol_type = other RNA
agcgccggcatgatcatcatgctgatccccaccgtgatggccttccacctgaccaccagaaacggcgagccccacatgatcgtgagcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcagaatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccaagaccgccgagtgccccaacaccaacagagcctggaacagcctggaggtggaggactacggcttcggcgtgttcaccaccaacatctggctgaagctgaaggagaagcaggacgccctgtgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgatcctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggagaaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctggccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggtgttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgagatacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgccaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaagatcagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17708 - RNA, 9876 nt, synthetic construct
  misc_feature 1..9876: note = derived and/or modified CDS sequence (opt4) from DENV-2__AF169683__SS-prME
  source 1..9876: mol_type = other RNA
agcgccggcatgatcatcatgctgatccccaccgtgatggccttccacctgaccaccagaaacggcgagccccacatgatcgtgagcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcagaatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcacgccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgatcctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacttcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctggccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggtgttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagagccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcatcaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcctggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgccaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaagatcagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17709 - RNA, 9876 nt, synthetic construct
  misc_feature 1..9876: note = derived and/or modified CDS sequence (opt4) from DENV-2__AF169684__SS-prME
  source 1..9876: mol_type = other RNA
agcgccggcatgatcatcatgctgatccccaccgtgatggccttccacctgaccaccagaaacggcgagccccacatgatcgtgagcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcagaatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgatcctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcagaagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagaagtacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacttcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctggccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcttcctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaagatacggcggcgccctggtgagaaaccccctgagcagaaacagcacccacgagatgtactgggtgagcaacgccagcggcaacatcgtgagcagcgtgaacatgatcagcagaatgctgatcaacagattcaccatgaagcacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgccaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaagatcagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17710 - RNA, 9876 nt, synthetic construct
  misc_feature 1..9876: note = derived and/or modified CDS sequence (opt4) from DENV-2__AF169685__SS-prME
  source 1..9876: mol_type = other RNA
agcgccggcatgatcatcatgctgatccccaccgtgatggccttccacctgaccaccagaaacggcgagccccacatgatcgtgagcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcagaatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgatcctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacttcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctggccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggtgttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaagatacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgccaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaagatcagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17711 - RNA, 9876 nt, synthetic construct
  misc_feature 1..9876: note = derived and/or modified CDS sequence (opt4) from DENV-2__AF169686__SS-prME
  source 1..9876: mol_type = other RNA
agcgccggcatgatcatcatgctgatccccaccgtgatggccttccacctgaccaccagaaacggcgagccccacatgatcgtgagcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcagaatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcttcatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgatcctgaccagcagccagcagaagaccgactggatccccctggccctgaccatcaagggcctgaaccccaccgccatcttcctgaccaccctgagcagaaccaacaagaagagaagctggcccgtgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagaagtacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacttcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctggccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggtgttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaagatacggcggcgccctggtgagaaaccccctgagcagaaacagcacccacgagatgtactgggtgagcaacgccagcggcaacatcgtgagcagcgtgaacatgatcagcagaatgctgatcaacagattcaccatgaagcacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgagaccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgccaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaagatcagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17712 - RNA, 9876 nt, synthetic construct
  misc_feature 1..9876: note = derived and/or modified CDS sequence (opt4) from DENV-2__AF169687__SS-prME
  source 1..9876: mol_type = other RNA
agcgccggcatgatcatcatgctgatccccaccgtgatggccttccacctgaccaccagaaacggcgagccccacatgatcgtgagcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcagaatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcacgccggcaagagaagcctgagaccccagcccaccgagctgaagtacagctggaagacctggggcatcgccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgaccgtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgatcctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacttcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctggccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggtgttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggcagcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcagccacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgccaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaagatcagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17713 - RNA, 9876 nt, synthetic construct
  misc_feature 1..9876: note = derived and/or modified CDS sequence (opt4) from DENV-2__AF169688__SS-prME
  source 1..9876: mol_type = other RNA
agcgccggcatgatcatcatgctgatccccaccgtgatggccttccacctgaccaccagaaacggcgagccccacatgatcgtgagcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagaccagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcagaatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcacgccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgatcctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacttcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctggccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggtgttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcaagaccctgggcgagaagtggaagagcagactgaacgccctgggcaagatcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgccaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaagatcagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17714 - RNA, 9873 nt, synthetic construct
  misc_feature 1..9873: note = derived and/or modified CDS sequence (opt4) from DENV-3__AB189125__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagagcccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagctgatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcagcaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcatcatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcatcctggagcagggcaagagaaccctgaccccccagcccatggagctgaagtacagctggaagacctggggcaaggccaagatcgtgaccgccgagatccagaacagcagcttcatcatcgacggccccaacacccccgagtgccccaacgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgatgtgcagcaacaccatcttcaccctgaccgtggcctggagaaccgccaccctgatcctggccggcatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccagctgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgactggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacgtggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgtgatgctgttcctgatcagcggcaagggcgtgggcaagaccagcatcggcctgatctgcgtggtggccagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacctacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccaagcccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaagaccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaagccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 17715 - RNA, 9873 nt, synthetic construct
  misc_feature 1..9873: note = derived and/or modified CDS sequence (opt4) from DENV-3__AB189126__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagagcccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagctgatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcagcaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcatcatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaaggtggtgaccgccgagatccagaacagcagcttcatcatcgacggccccaacacccccgagtgccccaacgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcatcctgttcatcttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgactggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcgtgggcaagaccagcatcggcctgatctgcgtggtggccagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgccccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccaagcccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaagaccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagctggagggcgccatctggtga

SEQ ID NO: 17716 - RNA, 9873 nt, synthetic construct
  misc_feature 1..9873: note = derived and/or modified CDS sequence (opt4) from DENV-3__AB189127__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagagcccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagctgatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcagcaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcatcatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaaggtggtgaccgccgagatccagaacagcagcttcatcatcgacggccccaacacccccgagtgccccaacgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccatccacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcatcctgttcatgttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccagctgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgactggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcgtgggcaagaccagcatcggcctgatctgcgtggtggccagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgccccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccaagcccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaagaccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagctggagggcgccatctggtga

SEQ ID NO: 17717 - RNA, 9873 nt, synthetic construct
  misc_feature 1..9873: note = derived and/or modified CDS sequence (opt4) from DENV-3__AB189128__SS-prME
  source 1..9873: mol_type = other RNA
accagcctgtgcctgatgatgatcctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccgtgctggccctgttcctggcccacttcatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccaccgagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggagtacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgatgtgcagcaacaccatcttcaccctgaccgtggcctggagaaccgccaccctgatcctggccggcatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccaacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggacggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccatcagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctgatcctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaagatcacccagtggctggaggccgagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggccacaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 17718 - RNA, 9873 nt, synthetic construct
  misc_feature 1..9873: note = derived and/or modified CDS sequence (opt4) from DENV-3__AB214879__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcgtgttcgccggccacctgaagtgcagactgaagatggacaagctggagctgaagggcatgagctacgccatgtgcagcaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcatcatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgaccagcctgatgtgcagcaacaccatcttcaccctgaccgtggcctggagaaccgccaccctgatcctggccggcatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagagcggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgactggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccttcgacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacctacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccaagcccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaagaccgacctggagaacccccacctgctggagaagagaatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 17719 - RNA, 9873 nt, synthetic construct
  misc_feature 1..9873: note = derived and/or modified CDS sequence (opt4) from DENV-3__AB214880__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcagcaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcatcatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggccagcctgatgtgcagcaacaccatcttcaccctgaccgtggcctggagaaccgccaccctgatcctggccggcatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagagcggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgactggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccttcgacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacctacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccaagcccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaagaccgacctggagaacccccacctgctggagaagagaatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 17720 - RNA, 9873 nt, synthetic construct
  misc_feature 1..9873: note = derived and/or modified CDS sequence (opt4) from DENV-3__AB214881__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcagcaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcatcatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcatcctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggccagcctgatgtgcagcaacaccatcttcaccctgaccgtggcctggagaaccgccaccctgatcctggccggcatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagagcggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgactggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccttcgacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacctacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccaagcccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaagaccgacctggagaacccccacctgctggagaagagaatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagctggagggcgccatctggtga

SEQ ID NO: 17721 - RNA, 9873 nt, synthetic construct
  misc_feature 1..9873: note = derived and/or modified CDS sequence (opt4) from DENV-3__AB214882__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcagcaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcatcatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcaccggcatcctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggccagcctgatgtgcagcaacaccatcttcaccctgaccgtggcctggagaaccgccaccctgatcctggccggcatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagagcggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgactggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccttcgacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacctacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccaagcccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaagaccgacctggagaacccccacctgctggagaagagaatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 17722 - RNA, 9873 nt, synthetic construct
  misc_feature 1..9873: note = derived and/or modified CDS sequence (opt4) from DENV-3__JX669489__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacagaggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatcgccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17723 - RNA, 9873 nt, synthetic construct
  misc_feature 1..9873: note = derived and/or modified CDS sequence (opt4) from DENV-3__JX669498__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcaccggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcggcaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17724 - RNA, 9873 nt, synthetic construct
  misc_feature 1..9873: note = derived and/or modified CDS sequence (opt4) from DENV-3__KF954946__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccatcctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcatcaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgtgggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagatgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatgctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggacggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccatggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgctgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatcaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagactgctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgagggcgtgctgagcaagaccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccatccccgtgcactgggtgcccaccagcagaaccacctggagcatccacgcccaccaccagtggatgaccaccgaggacatgctgaccgtgtggaacagagtgtggatcgaggacaacccctggatggaggacaagacccccatcaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17725 - RNA, 9873 nt, synthetic construct
  misc_feature 1..9873: note = derived and/or modified CDS sequence (opt4) from DENV-3__KF954947__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcatcaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgtgggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagatgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatgctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggacggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccatggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatcaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagagaatggaccccgagcacagactgctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgagggcgtgctgagcaagaccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccatccccgtgcactgggtgcccaccagcagaaccacctggagcatccacgcccaccaccagtggatgaccaccgaggacatgctgaccgtgtggaacagagtgtggatcgaggacaacccctggatggaggacaagacccccatcaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17726 - RNA, 9873 nt, synthetic construct
  misc_feature 1..9873: note = derived and/or modified CDS sequence (opt4) from DENV-3__KF954945__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccatcctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcatcaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgtgggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagatgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatgctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggacggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccatggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatcaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagactgctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgagggcgtgctgagcaagaccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccatccccgtgcactgggtgcccaccagcagaaccacctggagcatccacgcccaccaccagtggatgaccaccgaggacatgctgaccgtgtggaacagagtgtggatcgaggacaacccctggatggaggacaagacccccatcaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17727 - RNA, 9873 nt, synthetic construct
  misc_feature 1..9873: note = derived and/or modified CDS sequence (opt4) from DENV-3__JX669495__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaaggtgacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17728 - RNA, 9873 nt, synthetic construct
  misc_feature 1..9873: note = derived and/or modified CDS sequence (opt4) from DENV-3__JX669499__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcatcacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17729 - RNA, 9873 nt, synthetic construct
  misc_feature 1..9873: note = derived and/or modified CDS sequence (opt4) from DENV-3__JX669492__SS-prME
  source 1..9873: mol_type = other RNA
accagcttctgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17730 - RNA, 9873 nt, synthetic construct
  misc_feature 1..9873: note = derived and/or modified CDS sequence (opt4) from DENV-3__JX669500__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17731 - RNA, 9873 nt, synthetic construct
  misc_feature 1..9873: note = derived and/or modified CDS sequence (opt4) from DENV-3__JX669497__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccagcaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17732 - RNA, 9873 nt, synthetic construct
  misc_feature 1..9873: note = derived and/or modified CDS sequence (opt4) from DENV-3__JX669501__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacagaggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtggtgaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgaccatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccatggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatgtacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17733 - RNA, 9873 nt, synthetic construct
  misc_feature 1..9873: note = derived and/or modified CDS sequence (opt4) from DENV-3__JX669494__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcaccaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacagaggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacaccgtgagcagactgctgctgaacagattcaccatgacccacagaagacccaccaccgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17734 - RNA, 9873 nt, synthetic construct
  misc_feature 1..9873: note = derived and/or modified CDS sequence (opt4) from DENV-3__JX669503__SS-prME
  source 1..9873: mol_type = other RNA
accagcttctgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtggtgctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17735 - RNA, 9873 nt, synthetic construct
  misc_feature 1..9873: note = derived and/or modified CDS sequence (opt4) from DENV-3__JX669493__SS-prME
  source 1..9873: mol_type = other RNA
accagcttctgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatcggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17736 - RNA, 9873 nt, synthetic construct
  misc_feature 1..9873: note = derived and/or modified CDS sequence (opt4) from DENV-3__JX669504__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcaccaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacagaggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccctggtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacaccgtgagcagactgctgctgaacagattcaccatgacccacagaagacccaccaccgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17737 - RNA, 9873 nt, synthetic construct
  misc_feature 1..9873: note = derived and/or modified CDS sequence (opt4) from DENV-3__JX669506__SS-prME
  source 1..9873: mol_type = other RNA
accagcttctgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcctacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17738 - RNA, 9873 nt, synthetic construct
  misc_feature 1..9873: note = derived and/or modified CDS sequence (opt4) from DENV-3__JX669496__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcaccaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcgccaacaccttcgtgctgaagaaggaggtgagcgagacccagcacggcaccatcctgatcaaggtggagtacagaggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacaccgtgagcagactgctgctgaacagattcaccatgacccacagaagacccaccaccgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17739 - RNA, 9873 nt, synthetic construct
  misc_feature 1..9873: note = derived and/or modified CDS sequence (opt4) from DENV-3__JX669490__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacagaggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17740 - RNA, 9873 nt, synthetic construct
  misc_feature 1..9873: note = derived and/or modified CDS sequence (opt4) from DENV-3__JN406515__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagagcccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagctgatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcagcaacgccttcgtgctgaagaaggaggtgagcgagacccagcacggcaccatcctgatcaaggtggagtacaagggcgaggacgccccctgcaagatccccttcagcaccgaggacgagcagggcaaggcccacaacggcagactgatcaccgccaaccccgtggtgaccaagaaggaggagcccgtgaacatcgaggccgagccccccttcggcgagagcaacatcatcatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccaacgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacgtggagcagatggccaacggcatcgccctgggcctgatggccctgaagctgatcacccagttcgagacctaccagctgtggaccgccctggtgagcctgatgtgcagcaacaccatcttcaccctgaccgtggcctggagaaccgccaccctgatcctggccggcatcagcctgttccccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatgatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgactggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcgtgggcaagaccagcatcggcctgatctgcgtggtggccagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacctacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccaagcccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaagaccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaaggcccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 17741 - RNA, 9873 nt, synthetic construct
  misc_feature 1..9873: note = derived and/or modified CDS sequence (opt4) from DENV-3__JN406514__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcctggacctgcccctgccctggaccagcggcgccaccaccgagagacccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcagcaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcatctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacaagcagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17742 - RNA, 9873 nt, synthetic construct
  misc_feature 1..9873: note = derived and/or modified CDS sequence (opt4) from DENV-3__KT726340__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtgatcaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtggtggagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaaccccagactgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccatcaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga
